(12) United States Patent
Henry et al.

(10) Patent No.: US 12,043,670 B2
(45) Date of Patent: Jul. 23, 2024

(54) ANTI-BCMA ANTIBODY-DRUG CONJUGATES AND METHODS OF USE

(71) Applicant: Eisai R&D Management Co., Ltd., Tokyo (JP)

(72) Inventors: Ryan Henry, Milford, MA (US); Thiwanka Samarakoon, Westwood, MA (US); Nathan Fishkin, Weymouth, MA (US); Ping Zhu, Acton, MA (US); Ermira Pazolli, Wayland, MA (US); James Palacino, Wellesley, MA (US); Juan C. Almagro, Cambridge, MA (US)

(73) Assignee: Eisai R&D Management Co., Ltd., Tokyo (JP)

( * ) Notice: Subject to any disclaimer, the term of this patent is extended or adjusted under 35 U.S.C. 154(b) by 308 days.

(21) Appl. No.: 17/339,549

(22) Filed: Jun. 4, 2021

(65) Prior Publication Data

US 2022/0081486 A1 Mar. 17, 2022

Related U.S. Application Data

(60) Provisional application No. 62/704,997, filed on Jun. 5, 2020.

(51) Int. Cl.
| | |
|---|---|
| *C07K 16/28* | (2006.01) |
| *A61K 39/00* | (2006.01) |
| *A61K 39/395* | (2006.01) |
| *A61K 45/06* | (2006.01) |
| *A61K 47/60* | (2017.01) |
| *A61K 47/65* | (2017.01) |
| *A61K 47/68* | (2017.01) |
| *A61P 35/00* | (2006.01) |

(52) U.S. Cl.
CPC ...... *C07K 16/2878* (2013.01); *A61K 39/3955* (2013.01); *A61K 45/06* (2013.01); *A61K 47/60* (2017.08); *A61K 47/65* (2017.08); *A61K 47/6803* (2017.08); *A61K 47/6849* (2017.08); *A61P 35/00* (2018.01); *A61K 2039/505* (2013.01); *C07K 2317/92* (2013.01)

(58) Field of Classification Search
CPC ............ C07K 16/2878; C07K 2317/92; C07K 2317/565; A61K 39/3955; A61K 45/06; A61K 47/60; A61K 47/65; A61K 47/6803; A61K 47/6849; A61K 2039/505; A61K 47/6867; A61K 47/6889; A61P 35/00; A61P 35/02

See application file for complete search history.

(56) References Cited

U.S. PATENT DOCUMENTS

| | | | |
|---|---|---|---|
| 9,243,058 B2 * | 1/2016 | Armitage | ............... C07K 16/18 |
| 9,273,141 B2 | 3/2016 | Algate et al. | |
| 10,322,192 B2 | 6/2019 | Albone et al. | |
| 10,548,986 B2 | 2/2020 | Albone et al. | |
| 2018/0118842 A1 | 5/2018 | Brentjens et al. | |
| 2020/0297860 A1 | 9/2020 | Albone et al. | |
| 2021/0101888 A1 | 4/2021 | Pazolli et al. | |
| 2021/0299269 A1 | 9/2021 | Pazolli et al. | |
| 2022/0380352 A1 | 12/2022 | Pazolli et al. | |

FOREIGN PATENT DOCUMENTS

| | | |
|---|---|---|
| WO | WO 2014/068079 A1 | 5/2014 |
| WO | WO 2015/166073 A1 | 11/2015 |
| WO | WO 2016/090327 A2 | 6/2016 |
| WO | WO 2017/151979 A1 | 9/2017 |
| WO | WO 2017/211900 A1 | 12/2017 |
| WO | WO 2018/115466 A1 | 6/2018 |
| WO | WO 2018/148566 A1 | 8/2018 |
| WO | WO 2019/232433 A2 | 12/2019 |
| WO | WO 2019/232449 A9 | 12/2019 |
| WO | WO 2020/072390 A1 | 4/2020 |
| WO | WO 2020/123836 A2 | 6/2020 |
| WO | WO 2021/090062 A1 | 5/2021 |
| WO | WO 2021/148003 A1 | 7/2021 |

OTHER PUBLICATIONS

Edwards et al, J Mol Biol 334:103-118 (2003) (Year: 2003).*
Marchalonis et al., Dev & Comp Immunol 30:223-247 (2006) (Year: 2006).*
Almagro & Fransson, Frontiers in Bioscience 2008; 13:1619-33 (Year: 2008).*
Figueroa-Vazquez et al., (2021) "HDP-101, an Anti-BCMA Antibody-Drug Conjugate, Safely Delivers Amanitin to Induce Cell Death in Proliferating and Resting Multiple Myeloma Cells", Mol Cancer Ther., 20(2):367-378.
International Patent Application No. PCT/US2021/035913, filed Jun. 4, 2021, by Eisai R&D Management Co., Ltd., Partial International Search, mailed Sep. 10, 2021 (15 pages).
Tai et al., (2014) "Novel anti-B-cell maturation antigen antibody-drug conjugate (GSK2857916) selectively induces killing of multiple myeloma", Blood, 123(20):3128-3138.
Trudel et al., "Antibody-drug conjugate, GSK2857916, in relapsed/refractory multiple myeloma: an update on safety and efficacy from dose expansion phase I study", Blood Cancer Journal, 9(37):https://doi.org/10.1038/s41408-019-0196-6 (10 paged).

* cited by examiner

*Primary Examiner* — Julie Wu
*Assistant Examiner* — John L Van Druff
(74) *Attorney, Agent, or Firm* — Finnegan, Henderson, Farabow, Garrett & Dunner, LLP

(57) ABSTRACT

Antibodies, antigen-binding fragments, and conjugates (e.g., antibody-drug conjugates (ADCs) such as those comprising a splicing modulator) that bind to BCMA are disclosed. The disclosure further relates to methods and compositions for use in the treatment of cancer by administering a composition provided herein.

48 Claims, 33 Drawing Sheets
Specification includes a Sequence Listing.

ANTI-BCMA ANTIBODY-DRUG CONJUGATES AND METHODS OF USE

The present disclosure claims the benefit of priority to U.S. Provisional Patent Application No. 62/704,997, filed Jun. 5, 2020, which is incorporated herein by reference in its entirety.

SEQUENCE LISTING

The instant application contains a Sequence Listing which has been submitted electronically in ASCII format and is hereby incorporated by reference in its entirety. Said ASCII copy, created on Jul. 13, 2021, is named 15647 0012-00000 SL.txt and is 687.113 bytes in size.

The present disclosure relates to anti-B-cell maturation antigen (BCMA) antibodies and antigen-binding fragments thereof, as well as conjugates such as antibody-drug conjugates (ADCs), e.g., those comprising a splicing modulator, and their use.

The majority of protein-coding genes in the human genome are composed of multiple exons (including coding regions) that are separated by introns (non-coding regions). Gene expression results in precursor messenger RNA (pre-mRNA). The intron sequences are subsequently removed from the pre-mRNA by a process called splicing, which results in the mature messenger RNA (mRNA). By including different combinations of exons, alternative splicing gives rise to mRNAs encoding distinct protein isoforms.

RNA splicing is catalyzed by the spliceosome, a dynamic multiprotein-RNA complex composed of five small nuclear RNAs (snRNAs U1, U2, U4, U5, and U6) and associated proteins. The spliceosome assembles on pre-mRNAs to establish a dynamic cascade of multiple RNA and protein interactions that catalyze excision of the introns and ligation of exons (Matera and Wang (2014) Nat Rev Mol Cell Biol. 15(2):108-21). Accumulating evidence has linked human diseases to dysregulation in RNA splicing that impact many genes (Scotti and Swanson (2016) Nat Rev Genet. 17(1):19-32). Several studies have now documented alterations in the splicing profile of cancer cells, as well as in the splicing factors themselves (Agrawal et al. (2018) Curr Opin Genet Dev. 48:67-74). Alternative splicing can lead to differential exon inclusion/exclusion, intron retention, or usage of cryptic splice sites (Seiler et al. (2018) Cell Rep. 23(1):282-96). Altogether, these events account for functional changes that may contribute to tumorigenesis or resistance to therapy (Siegfried and Karni (2018) Curr Opin Genet Dev. 48:16-21).

Certain products can bind the SF3b spliceosome complex. These small molecules modulate splicing by promoting intron retention and/or exon skipping (Teng et al. (2017) Nat Commun. 8:15522). A significant portion of the resulting transcripts contain premature stop codons triggering nonsense mediated mRNA decay (NMD). Furthermore, because canonical splicing is impaired, canonical transcripts are considerably reduced, which can negatively impact cell function and viability. For this reason, splicing modulators have become a promising class of drugs for the treatment of cancer (Puthenveetil et al. (2016) Bioconjugate Chem. 27:1880-8). Delivery of these splicing modulators to the relevant oncogenic tissue while avoiding or minimizing potential toxicity presents an ongoing challenge in the field. Thus, improved targeting of small molecule splicing modulators would be desirable.

BCMA, also referred to as TNFRSF17 or CD269, is a member of the tumor necrosis factor receptor (TNFR) superfamily (Madry et al. (1998) Int Immunol. 10:1693-702; Sanchez et al. (2012) Br J Haematol. 158:727-38). Ligands for BCMA include B-cell activating factor (BAFF) and a proliferation-inducing ligand (APRIL) (Rennert et al. (2000) J Exp Med. 192:1677-83). BCMA is expressed preferentially by mature B lymphocytes, with minimal expression in hematopoietic stem cells and nonhematopoietic tissue, and plays a role in the survival of long-lived bone marrow plasma cells (PCs) (Novak et al. (2004) Blood. 103:689-94; O'Connor et al. (2004) 199:91-7).

BCMA is highly expressed on malignant PCs collected from patients with multiple myeloma (MM) compared with normal bone marrow mononuclear cells (BMMCs) from healthy donors (Sanchez et al. (2012) Br J Haematol. 158:727-38). BCMA overexpression and activation are also associated with progression of multiple myeloma in preclinical models and humans (Sanchez et al. (2012) Br J Haematol. 158:727-38; Tai et al. (2016) Blood. 127:3225-36; Sanchez et al. (2016) Clin Cancer Res. 22:3383-97). Murine xenografts with induced BCMA overexpression grow faster than BCMA-negative controls, and similar results are observed after APRIL-induced activation of BCMA in ex vivo human multiple myeloma cells (Tai et al. (2016) Blood. 127:3225-36). This overexpression and activation of BCMA may lead to the upregulation of canonical and non-canonical nuclear factor kappa-B (NFκB) pathways, as well as enhanced expression of genes critical for survival, growth, adhesion, osteoclast activation, angiogenesis, metastasis, and immunosuppression. BCMA represents a promising antigen for targeting multiple myeloma and other B-cell/plasma cell malignancies and/or delivering novel cancer treatments (Shah et el. (2020) Leukemia. 34(4):985-1005). Nevertheless, there remains a need for improved methods of targeting BCMA effectively.

In particular, while uses of splicing modulators have been reported in the art, including in the ADC context, there remains a need to better deliver splicing modulators in a targeted fashion to particular tissues, e.g., cancer tissues that express BCMA. Likewise, there remains a need in the art for improved antibodies that bind BCMA with superior properties, e.g., with respect to antigen binding and/or the ability to effectively deliver a payload such as a splicing modulator to a target cell or tissue expressing BCMA.

In various embodiments, the present disclosure provides, in part, novel antibodies and antigen-binding fragments that may be used alone, linked to one or more additional agents (e.g., as ADCs), or as part of a larger macromolecule (e.g., a bispecific antibody or multispecific antibody, alone or as part of a multispecific antibody linked to a payload in an ADC format). These may be administered as part of pharmaceutical compositions or combination therapies.

In some embodiments, the anti-BCMA antibodies and antigen-binding fragments disclosed herein are humanized. In some embodiments, the anti-BCMA antibodies and antigen-binding fragments disclosed herein contain minimal sequences derived from a non-human (e.g., mouse) antibody and retain the reactivity of the non-human antibody while being less immunogenic in human. In some embodiments, the anti-BCMA antibodies and antigen-binding fragments disclosed herein are capable of binding to BCMA. In some embodiments, the anti-BCMA antibodies and antigen-binding fragments disclosed herein bind to BCMA and possess one or more superior properties as compared to a reference anti-BCMA antibody or antigen-binding fragment. In some embodiments, the anti-BCMA antibodies and antigen-binding fragments disclosed herein have a higher affinity for BCMA (e.g., as evaluated in binding assays using cancer cells having a high or moderate level of BCMA expression), as compared to a reference anti-BCMA antibody or antigen-binding fragment. In some embodiments, ADCs comprising the anti-BCMA antibodies and antigen-binding fragments disclosed herein exhibit favorable drug loading, aggregation, stability, activity, and/or potency, as compared to an ADC comprising a reference anti-BCMA antibody or antigen-binding fragment. In some embodiments, ADCs comprising the anti-BCMA antibodies and antigen-binding fragments disclosed herein demonstrate desirable properties for a therapeutic ADC. In some embodiments, these properties include, but are not limited to, effective levels of drug loading, low aggregation levels, improved stability, retained affinity for BCMA-expressing cells comparable to unconjugated antibody, potent cytotoxicity against BCMA-expressing cells, improved cytotoxic and/or cytostatic activity against non-dividing and/or slowly-dividing cells, low levels of off-target cell killing, high levels of bystander killing, and/or effective in vivo anti-cancer activity, e.g., as compared to a reference anti-BCMA antibody and/or reference anti-BCMA ADC. In some embodiments, the increased potency, cytotoxicity, and/or anti-cancer activity is in a cancer expressing high levels of the antigen targeted by an antibody, antigen-binding fragment, or ADC disclosed herein (e.g., high BCMA expression). In some embodiments, the increased potency, cytotoxicity, and/or anti-cancer activity is in a cancer expressing moderate levels of the antigen targeted by an antibody, antigen-binding fragment, or ADC disclosed herein (e.g., moderate BCMA expression). In some embodiments, the antibodies, antigen-binding fragments, and/or ADCs may be useful for treating a human cancer patient.

In some embodiments, the cancer to be treated with an antibody, antigen-binding fragment, or ADC disclosed herein is multiple myeloma. Most patients with multiple myeloma eventually relapse. Without wishing to be bound by theory, myeloma patients may relapse due, at least in part, to the existence of "dormant" (e.g., non-dividing or slowly-dividing) myeloma cells, such as those present in skeletal niches throughout the body (Figueroa-Vazquez et al. (2021) Mol Cancer Ther. 20(2):367-378; Franqui-Machin et al. (2015) Oncotarget. 6:40496-40506). Such dormant myeloma cells may be largely resistant to standard-of-care therapies, including many FDA-approved chemotherapies, which can exert their anti-proliferative effects by inhibiting or dysregulating cellular pathways required for DNA replication and cell division (Cheung-Ong et al. (2013) Chem Biol. 20(5):648-659). Thus, therapeutic agents that retain anti-proliferative activity in non-dividing and/or slowly-dividing cells may provide an effective means of treating both newly-diagnosed and relapsed/refractory forms of multiple myeloma, as well as other B-cell/plasma cell malignancies. In some embodiments, the antibodies, antigen-binding fragments, conjugates, and/or ADC compounds disclosed herein retain cytotoxic and/or cytostatic activity independent of cell proliferation status. In some embodiments, the described antibodies, antigen-binding fragments, conjugates, and/or ADC compounds can target both actively-dividing and dormant cells (e.g., actively-dividing, non-dividing, and/or slowly-dividing myeloma cells).

Certain cancer types may be particularly suitable for treatment with the antibodies, antigen-binding fragments, conjugates, and/or ADCs compounds disclosed herein, based on, e.g., genetic background, gene expression pattern, or other defining characteristics of the cancer. In some embodiments, the increased potency, cytotoxicity, and/or anti-cancer activity of an antibody, antigen-binding fragment, or ADC disclosed herein (e.g., as compared to a reference anti-BCMA antibody and/or reference anti-BCMA ADC) is in a cancer expressing high or moderate levels of the antigen targeted by the antibody, antigen-binding fragment, or ADC (e.g., high or moderate BCMA expression). In some embodiments, the increased potency, cytotoxicity, and/or anti-cancer activity of an antibody, antigen-binding fragment, or ADC disclosed herein is in a cancer comprising at least some dormant cells, e.g., non-dividing or slowly-dividing myeloma cells. In some embodiments, the increased potency, cytotoxicity, and/or anti-cancer activity of an antibody, antigen-binding fragment, or ADC disclosed herein is in multiple myeloma. In some embodiments, the increased potency, cytotoxicity, and/or anti-cancer activity of an antibody, antigen-binding fragment, or ADC disclosed herein is in a cancer that expresses MCL1, e.g., a cancer having a high or moderate level of MCL1 expression.

MCL1 is a member of the BCL2 gene family, which are genes generally recognized as master regulators of the apoptotic form of programmed cell death. Three major alternative splicing isoforms of MCL1 have been described, with the longest isoform (MCL1-long, MCL1-L, MCL1L) serving as a potent pro-survival/anti-apoptotic factor that opposes the pro-death function of the pore-forming and BH3-only members of the family. In humans, MCL1 is broadly expressed across most normal tissues under normal physiological conditions, and is particularly enriched in myeloid cell types, including in plasma B cells, the cell type that gives rise to myeloma. MCL1 expression is frequently upregulated by different mechanisms across many cancer types, including myeloma, and has been shown to further increase in expression following some standard-of-care regimens for myeloma, conferring resistance to such therapies. Accordingly, without being bound by theory, therapeutic agents capable of inhibiting MCL1, e.g., MCL1L function, and/or suppressing MCL, e.g., MCL1L expression, may offer a clinical benefit to myeloma patients, especially in relapsed/refractory forms of the disease with high MCL1L expression or dependence.

Without wishing to be bound by theory, delivering splicing modulators to cancer cells, e.g., cancer cells that express BCMA, may induce cell death by reducing or inhibiting MCL1 expression (Aird et al. (2019) Nat Commun 10:137). MCL1 mRNA and protein are relatively short-lived, each with a half-life typically of approximately 30 minutes in several human cancer cell lines. Genes encoding short-lived RNA transcripts and proteins may be particularly suitable for modulation by splicing modulators, as the preexisting pool of properly spliced RNAs and protein products may be degraded quickly upon treatment while aberrantly spliced transcription products begin to accumulate. These aberrant splicing events often introduce missense or nonsense mutations, resulting in little or no functional protein output. In addition to affecting overall gene expression, splicing modulator treatment may also result in the expression of protein products with novel functions or functions that are antagonistic to the function of the properly spliced gene. In contrast to microtubule-disrupting or DNA-damaging payloads, splicing modulators as used in the ADCs described herein may disrupt MCL1 splicing and provide a pathway-specific apoptotic mechanism to kill hard-to-treat cancer cells (e.g., myeloma cells). By targeting the dependency of cancer cells on MCL1 splicing, the described antibodies, antigen-binding fragments, conjugates, and/or ADC compounds may offer effective therapeutic solutions for current clinical challenges, such as overcoming drug resistance in multiple myeloma and in other BCMA-expressing cancers.

The present disclosure more specifically relates, in various embodiments, to antibodies, antigen-binding fragments, and ADCs that are capable of binding BCMA-expressing cancer cells. In various embodiments, the antibodies, antigen-binding fragments, and ADCs are also capable of internalizing into a target cell after binding. ADCs comprising a linker that attaches a splicing modulator to an antibody moiety are disclosed. An antibody moiety (alone or as part of an ADC) may be a full-length antibody or an antigen-binding fragment thereof.

In some embodiments, the present disclosure provides an isolated antibody or antigen-binding fragment, wherein the antibody or antigen-binding fragment is capable of binding to BCMA and comprises:
(i) three heavy chain complementarity determining regions (HCDRs) and three light chain complementarity determining regions (LCDRs), as defined by the Kabat numbering system, comprising:
HCDR1 comprising an amino acid sequence of NYWIH (SEQ ID NO: 1);
HCDR2 comprising an amino acid sequence of $X_1TYRX_5X_6SX_8TX_{10}YX_{12}QKX_{15}KS$ (SEQ ID NO: 67), wherein:
$X_1$ is A or G;
$X_5$ is S, or I;
$X_6$ is H or Q;
$X_8$ is D or T;
$X_{10}$ is Y or N;
$X_{12}$ is N or A; and
$X_{15}$ is F or Y;
HCDR3 comprising an amino acid sequence of $GAX_3YHGYDVIX_{11}N$ (SEQ ID NO: 68), wherein:
$X_3$ is I or V; and
$X_{11}$ is E or D;
LCDR1 comprising an amino acid sequence of $RASQSISSYX_{10}N$ (SEQ ID NO: 69), wherein:
$X_{10}$ is L or I;
LCDR2 comprising an amino acid sequence of $ATSNLQX_7$ (SEQ ID NO: 70), wherein:
$X_7$ is S or I; and
LCDR3 comprising an amino acid sequence of $QQX_3RRX_6PWX_6$ (SEQ ID NO: 71), wherein:
$X_3$ is F or Y;
$X_6$ is L or I; and
$X_9$ is T or S; or
(ii) three heavy chain complementarity determining regions (HCDRs) and three light chain complementarity determining regions (LCDRs), as defined by the IMGT numbering system, comprising:
HCDR1 comprising an amino acid sequence of $GGTFX_5NYW$ (SEQ ID NO: 72), wherein:
$X_5$ is S or T;
HCDR2 comprising an amino acid sequence of $TYRX_4X_5SX_7T$ (SEQ ID NO: 73), wherein:
$X_4$ is S or I;
$X_5$ is H or Q; and
$X_7$ is D or T;
HCDR3 comprising an amino acid sequence of $ARGAX_5YHGYDVIX_{13}N$ (SEQ ID NO: 74), wherein:
$X_5$ is I or V; and
$X_{13}$ is D or E;
LCDR1 comprising an amino acid sequence of QSISSY (SEQ ID NO: 40);
LCDR2 comprising an amino acid sequence of ATS (SEQ ID NO: 41); and
LCDR3 comprising an amino acid sequence of $QQX_3RRX_6PWX_6$ (SEQ ID NO: 75), wherein:
$X_3$ is Y or F;
$X_6$ is L or I; and
$X_9$ is T or S.

In some embodiments, the present disclosure provides an isolated antibody or antigen-binding fragment, wherein the antibody or antigen-binding fragment is capable of binding to BCMA and comprises:
(a) three HCDRs comprising amino acid sequences of SEQ ID NO: 1 (HCDR1), SEQ ID NO: 2 (HCDR2), and SEQ ID NO: 3 (HCDR3); and three LCDRs comprising amino acid sequences of SEQ ID NO: 4 (LCDR1), SEQ ID NO: 5 (LCDR2), and SEQ ID NO: 6 (LCDR3), as defined by the Kabat numbering system; or three HCDRs comprising amino acid sequences of SEQ ID NO: 37 (HCDR1), SEQ ID NO: 38 (HCDR2), and SEQ ID NO: 39 (HCDR3); and three LCDRs comprising amino acid sequences of SEQ ID NO: 40 (LCDR1), SEQ ID NO: 41 (LCDR2), and SEQ ID NO: 42 (LCDR3), as defined by the IMGT numbering system;
(b) three HCDRs comprising amino acid sequences of SEQ ID NO: 1 (HCDR1), SEQ ID NO: 7 (HCDR2), and SEQ ID NO: 8 (HCDR3); and three LCDRs comprising amino acid sequences of SEQ ID NO: 9 (LCDR1), SEQ ID NO: 10 (LCDR2), and SEQ ID NO: 11 (LCDR3), as defined by the Kabat numbering system; or three HCDRs comprising amino acid sequences of SEQ ID NO: 43 (HCDR1), SEQ ID NO: 44 (HCDR2), and SEQ ID NO: 45 (HCDR3); and three LCDRs comprising amino acid sequences of SEQ ID NO: 40 (LCDR1), SEQ ID NO: 41 (LCDR2), and SEQ ID NO: 46 (LCDR3), as defined by the IMGT numbering system;
(c) three HCDRs comprising amino acid sequences of SEQ ID NO: 1 (HCDR1), SEQ ID NO: 12 (HCDR2), and SEQ ID NO: 13 (HCDR3); and three LCDRs comprising amino acid sequences of SEQ ID NO: 14 (LCDR1), SEQ ID NO: 15 (LCDR2), and SEQ ID NO: 16 (LCDR3), as defined by the Kabat numbering system; or three HCDRs comprising amino acid sequences of SEQ ID NO: 47 (HCDR1), SEQ ID NO: 48 (HCDR2), and SEQ ID NO: 49 (HCDR3); and three LCDRs comprising amino acid sequences of SEQ ID NO: 40 (LCDR1), SEQ ID NO: 41 (LCDR2), and SEQ ID NO: 50 (LCDR3), as defined by the IMGT numbering system;
(d) three HCDRs comprising amino acid sequences of SEQ ID NO: 1 (HCDR1), SEQ ID NO: 17 (HCDR2), and SEQ ID NO: 18 (HCDR3); and three LCDRs comprising amino acid sequences of SEQ ID NO: 19 (LCDR1), SEQ ID NO: 20 (LCDR2), and SEQ ID NO: 21 (LCDR3), as defined by the Kabat numbering system; or three HCDRs comprising amino acid sequences of SEQ ID NO: 51 (HCDR1), SEQ ID NO: 52 (HCDR2), and SEQ ID NO: 53 (HCDR3); and three LCDRs comprising amino acid sequences of SEQ ID NO: 40 (LCDR1), SEQ ID NO: 41 (LCDR2), and SEQ ID NO: 54 (LCDR3), as defined by the IMGT numbering system;
(e) three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system;

(f) three HCDRs comprising amino acid sequences of SEQ ID NO: 1 (HCDR1), SEQ ID NO: 27 (HCDR2), and SEQ ID NO: 28 (HCDR3); and three LCDRs comprising amino acid sequences of SEQ ID NO: 29 (LCDR1), SEQ ID NO: 30 (LCDR2), and SEQ ID NO: 31 (LCDR3), as defined by the Kabat numbering system; or three HCDRs comprising amino acid sequences of SEQ ID NO: 59 (HCDR1), SEQ ID NO: 60 (HCDR2), and SEQ ID NO: 61 (HCDR3); and three LCDRs comprising amino acid sequences of SEQ ID NO: 40 (LCDR1), SEQ ID NO: 41 (LCDR2), and SEQ ID NO: 62 (LCDR3), as defined by the IMGT numbering system; or (g) three HCDRs comprising amino acid sequences of SEQ ID NO: 1 (HCDR1), SEQ ID NO: 32 (HCDR2), and SEQ ID NO: 33 (HCDR3); and three LCDRs comprising amino acid sequences of SEQ ID NO: 34 (LCDR1), SEQ ID NO: 35 (LCDR2), and SEQ ID NO: 36 (LCDR3), as defined by the Kabat numbering system; or three HCDRs comprising amino acid sequences of SEQ ID NO: 63 (HCDR1), SEQ ID NO: 64 (HCDR2), and SEQ ID NO: 65 (HCDR3); and three LCDRs comprising amino acid sequences of SEQ ID NO: 40 (LCDR1), SEQ ID NO: 41 (LCDR2), and SEQ ID NO: 66 (LCDR3), as defined by the IMGT numbering system.

In some embodiments, the present disclosure provides an isolated antibody or antigen-binding fragment, wherein the antibody or antigen-binding fragment is capable of binding to BCMA and comprises:

(a) three HCDRs from a heavy chain variable region comprising an amino acid sequence of SEQ ID NO: 76, and three LCDRs from a light chain variable region comprising an amino acid sequence of SEQ ID NO: 77;

(b) three HCDRs from a heavy chain variable region comprising an amino acid sequence of SEQ ID NO: 78, and three LCDRs from a light chain variable region comprising an amino acid sequence of SEQ ID NO: 79;

(c) three HCDRs from a heavy chain variable region comprising an amino acid sequence of SEQ ID NO: 80, and three LCDRs from a light chain variable region comprising an amino acid sequence of SEQ ID NO: 81;

(d) three HCDRs from a heavy chain variable region comprising an amino acid sequence of SEQ ID NO: 82, and three LCDRs from a light chain variable region comprising an amino acid sequence of SEQ ID NO: 83;

(e) three HCDRs from a heavy chain variable region comprising an amino acid sequence of SEQ ID NO: 84, and three LCDRs from a light chain variable region comprising an amino acid sequence of SEQ ID NO: 85;

(f) three HCDRs from a heavy chain variable region comprising an amino acid sequence of SEQ ID NO: 86, and three LCDRs from a light chain variable region comprising an amino acid sequence of SEQ ID NO: 87; or (g) three HCDRs from a heavy chain variable region comprising an amino acid sequence of SEQ ID NO: 88, and three LCDRs from a light chain variable region comprising an amino acid sequence of SEQ ID NO: 89.

In some embodiments, an antibody or antigen-binding fragment disclosed herein comprises human heavy and light chain variable region frameworks, or human heavy and light chain variable region frameworks with one or more back mutations.

In some embodiments, an antibody or antigen-binding fragment disclosed herein comprises:

(a) a heavy chain variable region that is at least 90% identical to an amino acid sequence of SEQ ID NO: 76, and a light chain variable region that is at least 90% identical to an amino acid sequence of SEQ ID NO: 77;

(b) a heavy chain variable region that is at least 90% identical to an amino acid sequence of SEQ ID NO: 78, and a light chain variable region that is at least 90% identical to an amino acid sequence of SEQ ID NO: 79;

(c) a heavy chain variable region that is at least 90% identical to an amino acid sequence of SEQ ID NO: 80, and a light chain variable region that is at least 90% identical to an amino acid sequence of SEQ ID NO: 81;

(d) a heavy chain variable region that is at least 90% identical to an amino acid sequence of SEQ ID NO: 82, and a light chain variable region that is at least 90% identical to an amino acid sequence of SEQ ID NO: 83;

(e) a heavy chain variable region that is at least 90% identical to an amino acid sequence of SEQ ID NO: 84, and a light chain variable region that is at least 90% identical to an amino acid sequence of SEQ ID NO: 85;

(f) a heavy chain variable region that is at least 90% identical to an amino acid sequence of SEQ ID NO: 86, and a light chain variable region that is at least 90% identical to an amino acid sequence of SEQ ID NO: 87; or (g) a heavy chain variable region that is at least 90% identical to an amino acid sequence of SEQ ID NO: 88, and a light chain variable region that is at least 90% identical to an amino acid sequence of SEQ ID NO: 89.

In some embodiments, an antibody or antigen-binding fragment disclosed herein comprises:

(a) a heavy chain variable region comprising an amino acid sequence of SEQ ID NO: 76, and a light chain variable region comprising an amino acid sequence of SEQ ID NO: 77;

(b) a heavy chain variable region comprising an amino acid sequence of SEQ ID NO: 78, and a light chain variable region comprising an amino acid sequence of SEQ ID NO: 79;

(c) a heavy chain variable region comprising an amino acid sequence of SEQ ID NO: 80, and a light chain variable region comprising an amino acid sequence of SEQ ID NO: 81;

(d) a heavy chain variable region comprising an amino acid sequence of SEQ ID NO: 82, and a light chain variable region comprising an amino acid sequence of SEQ ID NO: 83;

(e) a heavy chain variable region comprising an amino acid sequence of SEQ ID NO: 84, and a light chain variable region comprising an amino acid sequence of SEQ ID NO: 85;

(f) a heavy chain variable region comprising an amino acid sequence of SEQ ID NO: 86, and a light chain variable region comprising an amino acid sequence of SEQ ID NO: 87; or (g) a heavy chain variable region comprising an amino acid sequence of SEQ ID NO: 88, and a light chain variable region comprising an amino acid sequence of SEQ ID NO: 89.

In some embodiments, an antibody or antigen-binding fragment disclosed herein comprises:

(a) three HCDRs comprising amino acid sequences of SEQ ID NO: 1 (HCDR1), SEQ ID NO: 2 (HCDR2), and SEQ ID NO: 3 (HCDR3); and three LCDRs comprising amino acid sequences of SEQ ID NO: 4 (LCDR1), SEQ ID NO: 5 (LCDR2), and SEQ ID NO: 6 (LCDR3), as defined by the Kabat numbering system; or three HCDRs comprising amino acid sequences of SEQ ID NO: 37 (HCDR1), SEQ ID NO: 38 (HCDR2), and SEQ ID NO: 39 (HCDR3); and three LCDRs comprising amino acid sequences of SEQ ID NO: 40 (LCDR1), SEQ ID NO: 41 (LCDR2), and SEQ ID NO: 42 (LCDR3), as defined by the IMGT numbering system; or (b) three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system.

In some embodiments, the antibody or antigen-binding fragment comprises:

(a) a heavy chain variable region comprising an amino acid sequence of SEQ ID NO: 76, and a light chain variable region comprising an amino acid sequence of SEQ ID NO: 77; or (b) a heavy chain variable region comprising an amino acid sequence of SEQ ID NO: 84, and a light chain variable region comprising an amino acid sequence of SEQ ID NO: 85.

In some embodiments, an antibody or antigen-binding fragment disclosed herein comprises three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system. In some embodiments, the antibody or antigen-binding fragment comprises a heavy chain variable region comprising an amino acid sequence of SEQ ID NO: 84, and a light chain variable region comprising an amino acid sequence of SEQ ID NO: 85.

In some embodiments, the present disclosure provides an isolated antibody or antigen-binding fragment, wherein the antibody or antigen-binding fragment is capable of binding to BCMA and comprises:

(a) a heavy chain variable region comprising an amino acid sequence of SEQ ID NO: 119 modified to include an amino acid substitution at one or more of positions 30, 34, 50, 54, 55, 57, 59, 61, 64, 66, 101, 103, 108, and 109; and (b) a light chain variable region comprising an amino acid sequence of SEQ ID NO: 120 modified to include an amino acid substitution at one or more of positions 24, 28, 31, 33, 50, 55, 56, 91, 93, 94, and 97.

In some embodiments, the antibody or antigen-binding fragment comprises a heavy chain variable region comprising an amino acid sequence of SEQ ID NO: 119 modified to include an amino acid substitution at one or more of positions 30, 34, 50, 54, 55, 57, 59, 61, 64, 66, 101, 103, 108, and 109, wherein:

the amino acid at position 30 of SEQ ID NO: 119 is substituted with T;
the amino acid at position 34 of SEQ ID NO: 119 is substituted with I;
the amino acid at position 50 of SEQ ID NO: 119 is substituted with G;
the amino acid at position 54 of SEQ ID NO: 119 is substituted with S or I;
the amino acid at position 55 of SEQ ID NO: 119 is substituted with Q;
the amino acid at position 57 of SEQ ID NO: 119 is substituted with T;
the amino acid at position 59 of SEQ ID NO: 119 is substituted with N;
the amino acid at position 61 of SEQ ID NO: 119 is substituted with A;
the amino acid at position 64 of SEQ ID NO: 119 is substituted with Y;
the amino acid at position 66 of SEQ ID NO: 119 is substituted with S;
the amino acid at position 101 of SEQ ID NO: 119 is substituted with V;
the amino acid at position 103 of SEQ ID NO: 119 is substituted with H;
the amino acid at position 108 of SEQ ID NO: 119 is substituted with I; and/or
the amino acid at position 109 of SEQ ID NO: 119 is substituted with E.

In some embodiments, the antibody or antigen-binding fragment comprises a heavy chain variable region comprising an amino acid sequence of SEQ ID NO: 119 modified to include at least an amino acid substitution at position 103. In some embodiments, the amino acid at position 103 of SEQ ID NO: 119 is substituted with H.

In some embodiments, the antibody or antigen-binding fragment comprises a heavy chain variable region comprising an amino acid sequence of SEQ ID NO: 119 modified to include at least four amino acid substitutions. In some embodiments, the antibody or antigen-binding fragment comprises a heavy chain variable region comprising an amino acid sequence of SEQ ID NO: 119 modified to include at least amino acid substitutions at positions 34, 66, 103, and 108. In some embodiments, the amino acid at position 34 of SEQ ID NO: 119 is substituted with I; the amino acid at position 66 of SEQ ID NO: 119 is substituted with S; the amino acid at position 103 of SEQ ID NO: 119 is substituted with H; and the amino acid at position 108 of SEQ ID NO: 119 is substituted with I.

In some embodiments, the antibody or antigen-binding fragment comprises a light chain variable region comprising an amino acid sequence of SEQ ID NO: 120 modified to include an amino acid substitution at one or more of positions 24, 28, 31, 33, 50, 55, 56, 91, 93, 94, and 97, wherein:

the amino acid at position 24 of SEQ ID NO: 120 is substituted with R;
the amino acid at position 28 of SEQ ID NO: 120 is substituted with S;
the amino acid at position 31 of SEQ ID NO: 120 is substituted with S;
the amino acid at position 33 of SEQ ID NO: 120 is substituted with I;
the amino acid at position 50 of SEQ ID NO: 120 is substituted with A;
the amino acid at position 55 of SEQ ID NO: 120 is substituted with Q;
the amino acid at position 56 of SEQ ID NO: 120 is substituted with I;
the amino acid at position 91 of SEQ ID NO: 120 is substituted with F;
the amino acid at position 93 of SEQ ID NO: 120 is substituted with R;

the amino acid at position 94 of SEQ ID NO: 120 is substituted with I; and/or the amino acid at position 97 of SEQ ID NO: 120 is substituted with S.

In some embodiments, the antibody or antigen-binding fragment comprises a light chain variable region comprising an amino acid sequence of SEQ ID NO: 120 modified to include at least six amino acid substitutions. In some embodiments, the antibody or antigen-binding fragment comprises a light chain variable region comprising an amino acid sequence of SEQ ID NO: 120 modified to include at least amino acid substitutions at positions 24, 28, 31, 50, 55, and 93. In some embodiments, the amino acid at position 24 of SEQ ID NO: 120 is substituted with R; the amino acid at position 28 of SEQ ID NO: 120 is substituted with S; the amino acid at position 31 of SEQ ID NO: 120 is substituted with S; the amino acid at position 50 of SEQ ID NO: 120 is substituted with A; the amino acid at position 55 of SEQ ID NO: 120 is substituted with Q; and the amino acid at position 93 of SEQ ID NO: 120 is substituted with R.

In some embodiments, the antibody or antigen-binding fragment comprises:

(a) a heavy chain variable region that is at least 90% identical to an amino acid sequence of SEQ ID NO: 76, and a light chain variable region that is at least 90% identical to an amino acid sequence of SEQ ID NO: 77;

(b) a heavy chain variable region that is at least 90% identical to an amino acid sequence of SEQ ID NO: 78, and a light chain variable region that is at least 90% identical to an amino acid sequence of SEQ ID NO: 79;

(c) a heavy chain variable region that is at least 90% identical to an amino acid sequence of SEQ ID NO: 80, and a light chain variable region that is at least 90% identical to an amino acid sequence of SEQ ID NO: 81;

(d) a heavy chain variable region that is at least 90% identical to an amino acid sequence of SEQ ID NO: 82, and a light chain variable region that is at least 90% identical to an amino acid sequence of SEQ ID NO: 83;

(e) a heavy chain variable region that is at least 90% identical to an amino acid sequence of SEQ ID NO: 84, and a light chain variable region that is at least 90% identical to an amino acid sequence of SEQ ID NO: 85;

(f) a heavy chain variable region that is at least 90% identical to an amino acid sequence of SEQ ID NO: 86, and a light chain variable region that is at least 90% identical to an amino acid sequence of SEQ ID NO: 87; or (g) a heavy chain variable region that is at least 90% identical to an amino acid sequence of SEQ ID NO: 88, and a light chain variable region that is at least 90% identical to an amino acid sequence of SEQ ID NO: 89.

In some embodiments, the antibody or antigen-binding fragment comprises:

(a) a heavy chain variable region comprising an amino acid sequence of SEQ ID NO: 76, and a light chain variable region comprising an amino acid sequence of SEQ ID NO: 77;

(b) a heavy chain variable region comprising an amino acid sequence of SEQ ID NO: 78, and a light chain variable region comprising an amino acid sequence of SEQ ID NO: 79;

(c) a heavy chain variable region comprising an amino acid sequence of SEQ ID NO: 80, and a light chain variable region comprising an amino acid sequence of SEQ ID NO: 81;

(d) a heavy chain variable region comprising an amino acid sequence of SEQ ID NO: 82, and a light chain variable region comprising an amino acid sequence of SEQ ID NO: 83;

(e) a heavy chain variable region comprising an amino acid sequence of SEQ ID NO: 84, and a light chain variable region comprising an amino acid sequence of SEQ ID NO: 85;

(f) a heavy chain variable region comprising an amino acid sequence of SEQ ID NO: 86, and a light chain variable region comprising an amino acid sequence of SEQ ID NO: 87; or (g) a heavy chain variable region comprising an amino acid sequence of SEQ ID NO: 88, and a light chain variable region comprising an amino acid sequence of SEQ ID NO: 89.

In some embodiments, an antibody or antigen-binding fragment disclosed herein comprises a human IgG1 heavy chain constant region. In some embodiments, the antibody or antigen-binding fragment comprises a heavy chain constant region comprising an amino acid sequence of SEQ ID NO: 90. In some embodiments, the heavy chain constant region further comprises a C-terminal lysine (K). In some embodiments, an antibody or antigen-binding fragment disclosed herein comprises a human IgG4 heavy chain constant region.

In some embodiments, an antibody or antigen-binding fragment disclosed herein comprises a human Ig kappa light chain constant region. In some embodiments, the antibody or antigen-binding fragment comprises a light chain constant region comprising an amino acid sequence of SEQ ID NO: 91. In some embodiments, an antibody or antigen-binding fragment disclosed herein comprises a human Ig lambda light chain constant region.

In some embodiments, an antibody or antigen-binding fragment disclosed herein comprises a heavy chain constant region comprising an amino acid sequence of SEQ ID NO: 90, and a light chain constant region comprising an amino acid sequence of SEQ ID NO: 91.

In some embodiments, an antibody or antigen-binding fragment disclosed herein comprises:

(a) a heavy chain comprising an amino acid sequence of SEQ ID NO: 92, and a light chain comprising an amino acid sequence of SEQ ID NO: 93;

(b) a heavy chain comprising an amino acid sequence of SEQ ID NO: 94, and a light chain comprising an amino acid sequence of SEQ ID NO: 95;

(c) a heavy chain comprising an amino acid sequence of SEQ ID NO: 96, and a light chain comprising an amino acid sequence of SEQ ID NO: 97;

(d) a heavy chain comprising an amino acid sequence of SEQ ID NO: 98, and a light chain comprising an amino acid sequence of SEQ ID NO: 99;

(e) a heavy chain comprising an amino acid sequence of SEQ ID NO: 100, and a light chain comprising an amino acid sequence of SEQ ID NO: 101;

(f) a heavy chain comprising an amino acid sequence of SEQ ID NO: 102, and a light chain comprising an amino acid sequence of SEQ ID NO: 103; or (g) a heavy chain comprising an amino acid sequence of SEQ ID NO: 104, and a light chain comprising an amino acid sequence of SEQ ID NO: 105. In some embodiments, the heavy chain further comprises a C-terminal lysine (K).

In some embodiments, an antibody or antigen-binding fragment disclosed herein comprises:

(a) a heavy chain variable region comprising an amino acid sequence of SEQ ID NO: 76, and a light chain variable region comprising an amino acid sequence of SEQ ID NO: 77; or (b) a heavy chain variable region comprising an amino acid sequence of SEQ ID NO: 84, and a light chain variable region comprising an amino acid sequence of SEQ ID NO: 85.

In some embodiments, the antibody or antigen-binding fragment comprises:

(a) a heavy chain comprising an amino acid sequence of SEQ ID NO: 92, and a light chain comprising an amino acid sequence of SEQ ID NO: 93; or (b) a heavy chain comprising an amino acid sequence of SEQ ID NO: 100, and a light chain comprising an amino acid sequence of SEQ ID NO: 101.

In some embodiments, an antibody or antigen-binding fragment disclosed herein comprises a heavy chain variable region comprising an amino acid sequence of SEQ ID NO: 84, and a light chain variable region comprising an amino acid sequence of SEQ ID NO: 85. In some embodiments, the antibody or antigen-binding fragment comprises a heavy chain comprising an amino acid sequence of SEQ ID NO: 100, and a light chain comprising an amino acid sequence of SEQ ID NO: 101. In some embodiments, the heavy chain further comprises a C-terminal lysine (K).

In some embodiments, an antibody or antigen-binding fragment disclosed herein is conjugated to a therapeutic agent. In some embodiments, the therapeutic agent is a splicing modulator. In some embodiments, the therapeutic agent is a pladienolide or a pladienolide derivative. In some embodiments, the therapeutic agent is pladienolide D or a pladienolide D derivative.

In some embodiments, the therapeutic agent is D1:

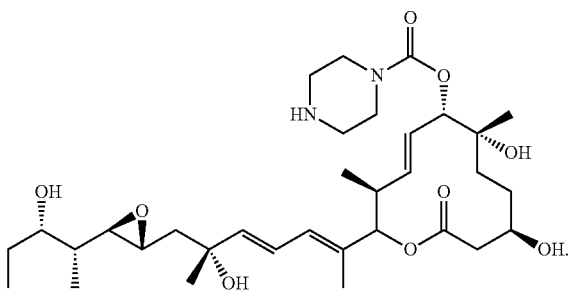

(D1)

In some embodiments, the therapeutic agent is D2:

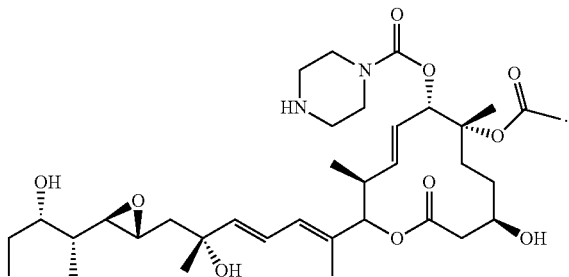 [SMILES: CC[C@H](O)[C@@H](C)[C@H]1O[C@@H]1C[C@@](C)(O)/C=C/C=C(\C)C1OC(=O)C[C@H](O)CC[C@@](C)(OC(C)=O)[C@@H](OC(=O)N2CCNCC2)/C=C/[C@@H]1C]

In some embodiments, an antibody-drug conjugate (ADC) disclosed herein comprises Formula (I):

$$\text{Ab-(L-D)}_p \qquad (I)$$

wherein

Ab is an antibody or antigen-binding fragment disclosed herein;

D is a splicing modulator;

L is a linker which covalently attaches Ab to D; and p is an integer from 1 to 15.

In some embodiments, the linker is a cleavable linker.

In some embodiments, the linker comprises a cleavable peptide moiety. In some embodiments, the cleavable peptide moiety is cleavable by an enzyme. In some embodiments, the cleavable peptide moiety or linker comprises an amino acid unit. In some embodiments, the amino acid unit comprises valine-citrulline (Val-Cit). In some embodiments, the amino acid unit comprises valine-alanine (Val-Ala). In some embodiments, the amino acid unit comprises alanine-alanine-aspartic acid (Ala-Ala-Asp). In some embodiments, the amino acid unit comprises glutamine-valine-citrulline (Glu-Val-Cit).

In some embodiments, the linker comprises a cleavable glucuronide moiety. In some embodiments, the cleavable glucuronide moiety is cleavable by an enzyme. In some embodiments, the cleavable glucuronide moiety is cleavable by a glucuronidase. In some embodiments, the cleavable glucuronide moiety is cleavable by β-glucuronidase. In some embodiments, the cleavable glucuronide moiety or linker comprises a β-glucuronide.

In some embodiments, the linker comprises a maleimide moiety. In some embodiments, the maleimide moiety comprises a maleimidocaproyl (MC). In some embodiments, the maleimide moiety is reactive with a cysteine residue on the antibody or antigen-binding fragment. In some embodiments, the maleimide moiety is attached to the antibody or antigen-binding fragment via a cysteine residue on the antibody or antigen-binding fragment.

In some embodiments, the linker comprises a maleimide moiety and a cleavable peptide moiety. In some embodiments, the cleavable peptide moiety comprises an amino acid unit. In some embodiments, the cleavable peptide moiety or amino acid unit comprises Val-Cit. In some embodiments, the cleavable peptide moiety or amino acid unit comprises Val-Ala. In some embodiments, the cleavable peptide moiety or amino acid unit comprises Ala-Ala-Asp. In some embodiments, the cleavable peptide moiety or amino acid unit comprises Glu-Val-Cit. In some embodiments, the linker comprises a maleimide moiety and a cleavable glucuronide moiety. In some embodiments, the cleavable glucuronide moiety comprises a β-glucuronide.

In some embodiments, the linker comprises at least one spacer unit. In some embodiments, a spacer unit in the linker comprises a polyethylene glycol (PEG) moiety. In some embodiments, the PEG moiety comprises -(PEG)$_m$- and m is an integer from 1 to 10. In some embodiments, m is 2. In some embodiments, a spacer unit in the linker is attached to the antibody or antigen-binding fragment via the maleimide moiety ("Mal-spacer unit"). In some embodiments, the Mal-spacer unit comprises a PEG moiety. In some embodiments, the Mal-spacer unit comprises MC.

In some embodiments, the linker comprises the Mal-spacer unit and a cleavable peptide moiety. In some embodiments, the cleavable peptide moiety comprises an amino acid unit. In some embodiments, the cleavable peptide moiety or amino acid unit comprises Val-Cit, Val-Ala, Ala-Ala-Asp, or Glu-Val-Cit. In some embodiments, the linker comprises the Mal-spacer unit and a cleavable glucuronide moiety. In some embodiments, the cleavable glucuronide moiety comprises a β-glucuronide.

In some embodiments, the maleimide moiety or Mal-spacer unit attaches the antibody or antigen-binding fragment to the cleavable moiety in the linker.

In some embodiments, the cleavable moiety in the linker comprises a cleavable peptide moiety. In some embodiments, the cleavable peptide moiety comprises an amino acid unit. In some embodiments, the cleavable peptide moiety or amino acid unit comprises Val-Cit, Val-Ala, Ala-Ala-Asp, or Glu-Val-Cit. In some embodiments, the linker comprises MC-Val-Cit. In some embodiments, the linker comprises MC-Val-Ala. In some embodiments, the linker comprises MC-Ala-Ala-Asp. In some embodiments, the linker comprises MC-Glu-Val-Cit. In some embodiments, the linker comprises MC-(PEG)$_2$-Val-Cit.

In some embodiments, the cleavable moiety in the linker comprises a cleavable glucuronide moiety. In some embodiments, the cleavable glucuronide moiety comprises a β-glucuronide. In some embodiments, the linker comprises MC-β-glucuronide.

In some embodiments, the cleavable moiety in the linker is directly attached to the splicing modulator. In some other embodiments, a spacer unit attaches the cleavable moiety in the linker to the splicing modulator. In some embodiments, cleavage of the conjugate releases the splicing modulator from the antibody or antigen-binding fragment and linker. In some embodiments, the spacer unit attaching the cleavable moiety in the linker to the splicing modulator is self-immolative.

In some embodiments, the spacer unit attaching the cleavable moiety in the linker to the splicing modulator comprises a p-aminobenzyloxycarbonyl (pABC). In some embodiments, the pABC attaches the cleavable moiety in the linker to the splicing modulator. In some embodiments, the cleavable moiety in the linker comprises a cleavable peptide moiety. In some embodiments, the cleavable peptide moiety comprises an amino acid unit. In some embodiments, the cleavable peptide moiety or amino acid unit comprises Val-Cit, Val-Ala, Ala-Ala-Asp, or Glu-Val-Cit. In some embodiments, the linker comprises Val-Cit-pABC. In some embodiments, the linker comprises Val-Ala-pABC. In some embodiments, the linker comprises Ala-Ala-Asp-pABC. In some embodiments, the linker comprises Glu-Val-Cit-pABC. In some embodiments, the cleavable moiety in the linker comprises a cleavable glucuronide moiety. In some embodiments, the cleavable glucuronide moiety comprises a β-glucuronide. In some embodiments, the linker comprises β-glucuronide-pABC.

In some embodiments, the cleavable linker comprises MC-Val-Cit-pABC, MC-Val-Ala-pABC, MC-Ala-Ala-Asp-pABC, MC-Glu-Val-Cit-pABC, MC-(PEG)$_2$-Val-Cit-pABC, or MC-β-glucuronide. In some embodiments, the cleavable linker comprises MC-Val-Cit-pABC. In some embodiments, the cleavable linker comprises MC-Val-Ala-pABC. In some embodiments, the cleavable linker comprises MC-Ala-Ala-Asp-pABC. In some embodiments, the cleavable linker comprises MC-Glu-Val-Cit-pABC. In some embodiments, the cleavable linker comprises MC-(PEG)$_2$-Val-Cit-pABC. In some embodiments, the cleavable linker comprises MC-β-glucuronide.

In some embodiments, the linker is a non-cleavable linker.

In some embodiments, the splicing modulator comprises a modulator of the SF3b complex. In some embodiments, the splicing modulator comprises a pladienolide or a pladienolide derivative. In some embodiments, the splicing modulator comprises pladienolide D or a pladienolide D derivative. In some embodiments, the splicing modulator comprises D1 or D2. In some embodiments, the splicing modulator comprises D1. In some embodiments, the splicing modulator comprises D2.

In some embodiments, p is from 1 to 12. In some embodiments, p is from 2 to 8. In some embodiments, p is from 4 to 8. In some embodiments, p is 4. In some embodiments, p is 8.

In some embodiments, an ADC disclosed herein comprises Formula (I):

Ab-(L-D)$_p$         (I)

wherein

Ab is an antibody or antigen-binding fragment disclosed herein;

D is D1;

L is a linker which covalently attaches Ab to D; and p is an integer from 1 to 15.

In some embodiments, an ADC disclosed herein comprises Formula (I):

Ab-(L-D)$_p$         (I)

wherein

Ab is an antibody or antigen-binding fragment disclosed herein;

D is D2;

L is a linker which covalently attaches Ab to D; and p is an integer from 1 to 15.

In some embodiments, the antibody or antigen-binding fragment of an ADC disclosed herein comprises:

(a) three HCDRs comprising amino acid sequences of SEQ ID NO: 1 (HCDR1), SEQ ID NO: 2 (HCDR2), and SEQ ID NO: 3 (HCDR3); and three LCDRs comprising amino acid sequences of SEQ ID NO: 4 (LCDR1), SEQ ID NO: 5 (LCDR2), and SEQ ID NO: 6 (LCDR3), as defined by the Kabat numbering system; or three HCDRs comprising amino acid sequences of SEQ ID NO: 37 (HCDR1), SEQ ID NO: 38 (HCDR2), and SEQ ID NO: 39 (HCDR3); and three LCDRs comprising amino acid sequences of SEQ ID NO: 40 (LCDR1), SEQ ID NO: 41 (LCDR2), and SEQ ID NO: 42 (LCDR3), as defined by the IMGT numbering system;

(b) three HCDRs comprising amino acid sequences of SEQ ID NO: 1 (HCDR1), SEQ ID NO: 7 (HCDR2), and SEQ ID NO: 8 (HCDR3); and three LCDRs comprising amino acid sequences of SEQ ID NO: 9 (LCDR1), SEQ ID NO: 10 (LCDR2), and SEQ ID NO: 11 (LCDR3), as defined by the Kabat numbering system; or three HCDRs comprising amino acid sequences of SEQ ID NO: 43 (HCDR1), SEQ ID NO: 44 (HCDR2), and SEQ ID NO: 45 (HCDR3); and three LCDRs comprising amino acid sequences of SEQ ID NO: 40 (LCDR1), SEQ ID NO: 41 (LCDR2), and SEQ ID NO: 46 (LCDR3), as defined by the IMGT numbering system;

(c) three HCDRs comprising amino acid sequences of SEQ ID NO: 1 (HCDR1), SEQ ID NO: 12 (HCDR2), and SEQ ID NO: 13 (HCDR3); and three LCDRs comprising amino acid sequences of SEQ ID NO: 14 (LCDR1), SEQ ID NO: 15 (LCDR2), and SEQ ID NO: 16 (LCDR3), as defined by the Kabat numbering system; or three HCDRs comprising amino acid sequences of SEQ ID NO: 47 (HCDR1), SEQ ID NO: 48 (HCDR2), and SEQ ID NO: 49 (HCDR3); and three LCDRs comprising amino acid sequences of SEQ ID NO: 40 (LCDR1), SEQ ID NO: 41 (LCDR2), and SEQ ID NO: 50 (LCDR3), as defined by the IMGT numbering system;

(d) three HCDRs comprising amino acid sequences of SEQ ID NO: 1 (HCDR1), SEQ ID NO: 17 (HCDR2), and SEQ ID NO: 18 (HCDR3); and three LCDRs comprising amino acid sequences of SEQ ID NO: 19 (LCDR1), SEQ ID NO: 20 (LCDR2), and SEQ ID NO: 21 (LCDR3), as defined by the Kabat numbering system; or three HCDRs comprising amino acid sequences of SEQ ID NO: 51 (HCDR1), SEQ ID NO: 52 (HCDR2), and SEQ ID NO: 53 (HCDR3); and three LCDRs comprising amino acid sequences of SEQ ID NO: 40 (LCDR1), SEQ ID NO: 41 (LCDR2), and SEQ ID NO: 54 (LCDR3), as defined by the IMGT numbering system;

(e) three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system;

(f) three HCDRs comprising amino acid sequences of SEQ ID NO: 1 (HCDR1), SEQ ID NO: 27 (HCDR2), and SEQ ID NO: 28 (HCDR3); and three LCDRs comprising amino acid sequences of SEQ ID NO: 29 (LCDR1), SEQ ID NO: 30 (LCDR2), and SEQ ID NO: 31 (LCDR3), as defined by the Kabat numbering system; or three HCDRs comprising amino acid sequences of SEQ ID NO: 59 (HCDR1), SEQ ID NO: 60 (HCDR2), and SEQ ID NO: 61 (HCDR3); and three LCDRs comprising amino acid sequences of SEQ ID NO: 40 (LCDR1), SEQ ID NO: 41 (LCDR2), and SEQ ID NO: 62 (LCDR3), as defined by the IMGT numbering system; or (g) three HCDRs comprising amino acid sequences of SEQ ID NO: 1 (HCDR1), SEQ ID NO: 32 (HCDR2), and SEQ ID NO: 33 (HCDR3); and three LCDRs comprising amino acid sequences of SEQ ID NO: 34 (LCDR1), SEQ ID NO: 35 (LCDR2), and SEQ ID NO: 36 (LCDR3), as defined by the Kabat numbering system; or three HCDRs comprising amino acid sequences of SEQ ID NO: 63 (HCDR1), SEQ ID NO: 64 (HCDR2), and SEQ ID NO: 65 (HCDR3); and three LCDRs comprising amino acid sequences of SEQ ID NO: 40 (LCDR1), SEQ ID NO: 41 (LCDR2), and SEQ ID NO: 66 (LCDR3), as defined by the IMGT numbering system.

In some embodiments, the antibody or antigen-binding fragment of the ADC comprises human heavy and light chain variable region frameworks, or human heavy and light chain variable region frameworks with one or more back mutations.

In some embodiments, the antibody or antigen-binding fragment of the ADC comprises:

(a) a heavy chain variable region that is at least 90% identical to an amino acid sequence of SEQ ID NO: 76, and a light chain variable region that is at least 90% identical to an amino acid sequence of SEQ ID NO: 77;

(b) a heavy chain variable region that is at least 90% identical to an amino acid sequence of SEQ ID NO: 78, and a light chain variable region that is at least 90% identical to an amino acid sequence of SEQ ID NO: 79;

(c) a heavy chain variable region that is at least 90% identical to an amino acid sequence of SEQ ID NO: 80, and a light chain variable region that is at least 90% identical to an amino acid sequence of SEQ ID NO: 81;

(d) a heavy chain variable region that is at least 90% identical to an amino acid sequence of SEQ ID NO: 82, and a light chain variable region that is at least 90% identical to an amino acid sequence of SEQ ID NO: 83;

(e) a heavy chain variable region that is at least 90% identical to an amino acid sequence of SEQ ID NO: 84, and a light chain variable region that is at least 90% identical to an amino acid sequence of SEQ ID NO: 85;

(f) a heavy chain variable region that is at least 90% identical to an amino acid sequence of SEQ ID NO: 86, and a light chain variable region that is at least 90% identical to an amino acid sequence of SEQ ID NO: 87; or (g) a heavy chain variable region that is at least 90% identical to an amino acid sequence of SEQ ID NO: 88, and a light chain variable region that is at least 90% identical to an amino acid sequence of SEQ ID NO: 89.

In some embodiments, the antibody or antigen-binding fragment of the ADC comprises:

(a) a heavy chain variable region comprising an amino acid sequence of SEQ ID NO: 76, and a light chain variable region comprising an amino acid sequence of SEQ ID NO: 77;

(b) a heavy chain variable region comprising an amino acid sequence of SEQ ID NO: 78, and a light chain variable region comprising an amino acid sequence of SEQ ID NO: 79;

(c) a heavy chain variable region comprising an amino acid sequence of SEQ ID NO: 80, and a light chain variable region comprising an amino acid sequence of SEQ ID NO: 81;

(d) a heavy chain variable region comprising an amino acid sequence of SEQ ID NO: 82, and a light chain variable region comprising an amino acid sequence of SEQ ID NO: 83;

(e) a heavy chain variable region comprising an amino acid sequence of SEQ ID NO: 84, and a light chain variable region comprising an amino acid sequence of SEQ ID NO: 85;

(f) a heavy chain variable region comprising an amino acid sequence of SEQ ID NO: 86, and a light chain variable region comprising an amino acid sequence of SEQ ID NO: 87; or (g) a heavy chain variable region comprising an amino acid sequence of SEQ ID NO: 88, and a light chain variable region comprising an amino acid sequence of SEQ ID NO: 89.

In some embodiments, the antibody or antigen-binding fragment of an ADC disclosed herein comprises:

(a) three HCDRs comprising amino acid sequences of SEQ ID NO: 1 (HCDR1), SEQ ID NO: 2 (HCDR2), and SEQ ID NO: 3 (HCDR3); and three LCDRs comprising amino acid sequences of SEQ ID NO: 4 (LCDR1), SEQ ID NO: 5 (LCDR2), and SEQ ID NO: 6 (LCDR3), as defined by the Kabat numbering system; or three HCDRs comprising amino acid sequences of SEQ ID NO: 37 (HCDR1), SEQ ID NO: 38 (HCDR2), and SEQ ID NO: 39 (HCDR3); and three LCDRs comprising amino acid sequences of SEQ ID NO: 40 (LCDR1), SEQ ID NO: 41 (LCDR2), and SEQ ID NO: 42 (LCDR3), as defined by the IMGT numbering system; or (b) three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system.

In some embodiments, the antibody or antigen-binding fragment of the ADC comprises:

(a) a heavy chain variable region comprising an amino acid sequence of SEQ ID NO: 76, and a light chain variable region comprising an amino acid sequence of SEQ ID NO: 77; or (b) a heavy chain variable region comprising an amino acid sequence of SEQ ID NO: 84, and a light chain variable region comprising an amino acid sequence of SEQ ID NO: 85.

In some embodiments, the antibody or antigen-binding fragment of an ADC disclosed herein comprises three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system. In some embodiments, the antibody or antigen-binding fragment of the ADC comprises a heavy chain variable region comprising an amino acid sequence of SEQ ID NO: 84, and a light chain variable region comprising an amino acid sequence of SEQ ID NO: 85.

In some embodiments, an ADC disclosed herein comprises Formula (I):

$$Ab\text{-}(L\text{-}D)_p \qquad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system;

D is D1;

L is a linker which covalently attaches Ab to D; and p is an integer from 1 to 15.

In some embodiments, the antibody or antigen-binding fragment of an ADC disclosed herein comprises human heavy and light chain variable region frameworks, or human heavy and light chain variable region frameworks with one or more back mutations.

In some embodiments, the antibody or antigen-binding fragment of an ADC disclosed herein comprises a heavy chain variable region that is at least 90% identical to an amino acid sequence of SEQ ID NO: 84, and a light chain variable region that is at least 90% identical to an amino acid sequence of SEQ ID NO: 85. In some embodiments, the antibody or antigen-binding fragment of the ADC comprises a heavy chain variable region comprising an amino acid sequence of SEQ ID NO: 84, and a light chain variable region comprising an amino acid sequence of SEQ ID NO: 85.

In some embodiments, the antibody or antigen-binding fragment of an ADC disclosed herein comprises a human IgG1 heavy chain constant region, and a human Ig kappa light chain constant region. In some embodiments, the antibody or antigen-binding fragment of an ADC disclosed herein comprises a human IgG1 heavy chain constant region, and a human Ig lambda light chain constant region. In some embodiments, the antibody or antigen-binding fragment of an ADC disclosed herein comprises a human IgG4 heavy chain constant region, and a human Ig kappa light chain constant region. In some embodiments, the antibody or antigen-binding fragment of an ADC disclosed herein comprises a human IgG4 heavy chain constant region, and a human Ig lambda light chain constant region. In some embodiments, the antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 100, and a light chain comprising an amino acid sequence of SEQ ID NO: 101. In some embodiments, the heavy chain constant region or heavy chain further comprises a C-terminal lysine (K).

In some embodiments, the linker of an ADC disclosed herein is a cleavable linker. In some embodiments, the cleavable linker comprises MC-Val-Cit-pABC. In some embodiments, the cleavable linker comprises MC-Val-Ala-pABC. In some embodiments, the cleavable linker comprises MC-Ala-Ala-Asp-pABC. In some embodiments, the cleavable linker comprises MC-Glu-Val-Cit-pABC. In some embodiments, the cleavable linker comprises MC-(PEG)$_2$-Val-Cit-pABC. In some embodiments, the cleavable linker comprises MC-β-glucuronide.

In some embodiments, p of an ADC disclosed herein is from 1 to 12. In some embodiments, p is from 2 to 8. In some embodiments, p is from 4 to 8. In some embodiments, p is 4. In some embodiments, p is 8.

In some embodiments, an ADC disclosed herein comprises Formula (I):

$$Ab\text{-}(L\text{-}D)_p \qquad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system;

D is D1;

L is a linker comprising MC-Val-Cit-pABC (ADL1); and p is an integer from 1 to 15.

In some embodiments, the antibody or antigen-binding fragment of the ADC disclosed herein comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 84, and a light chain variable region comprising an amino acid sequence of SEQ ID NO: 85. In some embodiments, the antibody or antigen-binding fragment of the ADC comprises a human IgG1 heavy chain constant region, and a human Ig kappa light chain constant region. In some embodiments, the antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 100, and a light chain comprising an amino acid sequence of SEQ ID NO: 101. In some embodiments, the heavy chain constant region or heavy chain further comprises a C-terminal lysine (K). In some embodiments, p is from 1 to 12. In some embodiments, p is from 2 to 8. In some embodiments, p is from 4 to 8. In some embodiments, p is 4. In some embodiments, p is 8.

In some embodiments, an ADC disclosed herein comprises Formula (I):

$$Ab\text{-}(L\text{-}D)_p \qquad (I)$$

wherein

Ab is an antibody or antigen-binding fragment, wherein the antibody or antigen-binding fragment is capable of binding to BCMA and comprises a heavy chain variable region comprising an amino acid sequence of SEQ ID NO: 84, and a light chain variable region comprising an amino acid sequence of SEQ ID NO: 85;

D is D1;

L is a linker comprising MC-Val-Cit-pABC (ADL1); and p is an integer from 1 to 15.

In some embodiments, the antibody or antigen-binding fragment of the ADC comprises a human IgG1 heavy chain constant region, and a human Ig kappa light chain constant region. In some embodiments, the antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 100, and a light chain comprising an amino acid sequence of SEQ ID NO: 101. In some embodiments, the heavy chain constant region or heavy chain further comprises a C-terminal lysine (K). In some embodiments, p is from 1 to 12. In some embodiments, p is from 2 to 8. In some embodiments, p is from 4 to 8. In some embodiments, p is 4. In some embodiments, p is 8.

In various embodiments, provided herein are pharmaceutical compositions comprising the described antibodies, antigen-binding fragments, conjugates, and/or ADCs. In some embodiments, a pharmaceutical composition comprises one or more antibodies, one or more antigen-binding fragments, and/or one or more ADCs described herein along with at least a pharmaceutically acceptable carrier. In some embodiments, the pharmaceutical composition comprises multiple copies of the antibody, antigen-binding fragment, and/or ADC. In some embodiments, the pharmaceutical composition comprises multiple copies of an ADC disclosed herein, wherein the average p of the ADCs in the composition is from about 2 to about 8. In some embodiments, the average p of the ADCs in the composition is about 4.

In some embodiments, provided herein are therapeutic methods and uses for the described antibodies, antigen-binding fragments, conjugates, and/or ADC compounds or compositions, e.g., in treating cancer. In certain aspects, the present disclosure provides methods of treating a subject having or suspected of having a cancer by administering to the subject a therapeutically effective amount and/or regimen of any one of the antibodies, antigen-binding fragments, ADCs, and/or pharmaceutical compositions described herein. In certain aspects, the present disclosure provides methods of reducing or slowing the growth of a cancer cell population in a subject by administering to the subject a therapeutically effective amount and/or regimen of any one of the antibodies, antigen-binding fragments, ADCs, and/or pharmaceutical compositions described herein. In some embodiments, administration of the antibody, antigen-binding fragment, ADC, and/or pharmaceutical composition reduces the cancer cell population by at least about 10%, at least about 20%, at least about 50%, at least about 70%, at least about 80%, at least about 90%, at least about 95%, or at least about 99%. In some embodiments, administration of the antibody, antigen-binding fragment, ADC, and/or pharmaceutical composition slows the growth of the cancer cell population by at least about 10%, at least about 20%, at least about 50%, at least about 70%, at least about 80%, at least about 90%, at least about 95%, or at least about 99%. In some embodiments, the antibody, antigen-binding fragment, ADC, and/or pharmaceutical composition is administered in combination with one or more additional therapeutic agents. In some embodiments, the one or more additional therapeutic agents comprise a BCL2 inhibitor, a BCLxL inhibitor, a BCL2/BCLxL inhibitor, and/or a gamma secretase inhibitor.

In some embodiments of the therapeutic methods and uses disclosed herein, treatment with a described antibody, antigen-binding fragment, ADC, and/or pharmaceutical composition induces bystander killing of cancer cells which do not express a target antigen but are adjacent to cancer cells which express a target antigen. In some embodiments, the subject has one or more cancer cells which express a target antigen. In some embodiments, the target antigen is BCMA. In some embodiments, a described antibody, antigen-binding fragment, ADC, and/or pharmaceutical composition induces increased levels of bystander killing of cancer cells as compared to a reference, e.g., an alternate anti-BCMA ADC, such as, e.g., AB200-ADL10-MMAF.

In some embodiments of the therapeutic methods and uses disclosed herein, the cancer expresses BCMA. In some embodiments, the cancer is a plasma cell malignancy. In some embodiments, the plasma cell malignancy or cancer is a leukemia, lymphoma, plasmacytoma, or myeloma. In some embodiments, the plasma cell malignancy or cancer is multiple myeloma, diffuse large B-cell lymphoma, mantle cell lymphoma, plasmablastic lymphoma, plasmablastic myeloma, or Burkitt's lymphoma. In some embodiments, the plasma cell malignancy or cancer is multiple myeloma. In some embodiments, the plasma cell malignancy or cancer is relapsed/refractory multiple myeloma. In some embodiments, the plasma cell malignancy or cancer comprises actively-dividing cells, dormant cells, or both. In some embodiments, the plasma cell malignancy or cancer comprises at least some dormant cells, e.g., non-dividing or slowly-dividing myeloma cells. In some embodiments, the plasma cell malignancy or cancer expresses MCL1. In some embodiments, the plasma cell malignancy or cancer has a high or moderate level of MCL1 expression.

In some embodiments, provided herein are therapeutic methods and uses for the described antibodies, antigen-binding fragments, conjugates, and/or ADC compounds or compositions, e.g., in determining whether a subject having or suspected of having a cancer (e.g., a BCMA-expressing cancer) will be responsive to treatment with an agent targeting BCMA, e.g., an antibody, antigen-binding fragment, ADC, and/or pharmaceutical composition described herein. In some embodiments, the method comprises providing a biological sample from the subject; contacting the sample with an antibody or antigen-binding fragment disclosed herein; and detecting binding of the antibody or antigen-binding fragment to one or more cancer cells in the sample. In some embodiments, the one or more cancer cells express BCMA. In some embodiments, the cancer is a plasma cell malignancy. In some embodiments, the plasma cell malignancy or cancer is a leukemia, lymphoma, plasmacytoma, or myeloma. In some embodiments, plasma cell malignancy or cancer is multiple myeloma, diffuse large B-cell lymphoma, mantle cell lymphoma, plasmablastic lymphoma, plasmablastic myeloma, or Burkitt's lymphoma. In some embodiments, the plasma cell malignancy or cancer is multiple myeloma. In some embodiments, the plasma cell malignancy or cancer is relapsed/refractory multiple myeloma. In some embodiments, the biological sample is a blood sample or a bone marrow aspiration sample. In some embodiments, the blood sample is blood, a blood fraction, or one or more cells obtained from blood or a blood fraction.

In certain other aspects, the present disclosure provides pharmaceutical compositions comprising an antibody, antigen-binding fragment, conjugate, and/or ADC and a pharmaceutically acceptable diluent, carrier, and/or excipient. In some embodiments, nucleic acid(s) encoding an antibody or antigen-binding fragment of the present disclosure, or the antibody moiety in a conjugate and/or ADC of the present disclosure, are also provided. The nucleic acids may be in the form of an isolated nucleic acid, a nucleic acid incorporated into an isolated vector, and/or an antibody or antigen-binding fragment expressed by a cell or cell population under conditions suitable to produce the antibody or antigen-binding fragment.

In still other aspects, the present disclosure provides methods of producing the described antibodies, antigen-binding fragments, conjugates, and/or ADC compounds or compositions. In some embodiments, the present disclosure provides a method of producing an antibody or antigen-binding fragment by culturing a host cell or cell population modified to comprise one or more nucleic acids encoding an antibody or antigen-binding fragment described herein under conditions suitable to produce the antibody or antigen-binding fragment. In some embodiments, the present disclosure provides a method of producing an ADC by reacting an antibody or antigen-binding fragment described herein with a linker attached to a splicing modulator under conditions that allow conjugation. In some embodiments, the present disclosure provides a method of producing an ADC by reacting an antibody or antigen-binding fragment described herein with a linker and a splicing modulator under conditions that allow conjugation.

In some embodiments, the methods disclosed herein comprise reacting the antibody or antigen-binding fragment with the linker and the splicing modulator sequentially, wherein first the antibody or antigen-binding fragment reacts with the linker to form an antibody-linker intermediate, and then the antibody-linker intermediate reacts with the splicing modulator. In some other embodiments, the methods disclosed herein comprise reacting the antibody or antigen-binding fragment with the linker and the splicing modulator simultaneously. In some embodiments, the linker is a cleavable linker. In some embodiments, the cleavable linker comprises MC-Val-Cit-pABC. In some embodiments, the cleavable linker comprises MC-Val-Ala-pABC. In some embodiments, the cleavable linker comprises MC-Ala-Ala-Asp-pABC. In some embodiments, the cleavable linker comprises MC-Glu-Val-Cit-pABC. In some embodiments, the cleavable linker comprises MC-(PEG)$_2$-Val-Cit-pABC. In some embodiments, the cleavable linker comprises MC-β-glucuronide. In some embodiments, the splicing modulator comprises D1. In some embodiments, the splicing modulator comprises D2.

BRIEF DESCRIPTION OF THE DRAWINGS

FIG. 19A (experimental replicate #1) and FIG. 19B (experimental replicate #2) each show relative proliferation of NCI-H929 human myeloma cells treated with AB216-ADL1-D1 or AB200-ADL10-MMAF, under low serum conditions, as a percentage (%) of a time-matched untreated control at day 6.

FIG. 21A (experimental replicate #1) and FIG. 21B (experimental replicate #2) each show relative proliferation of OPM2 human myeloma cells treated with AB216-ADL1-D1 or AB200-ADL10-MMAF, under low serum conditions, as a percentage (%) of a time-matched untreated control at day 6.

DETAILED DESCRIPTION

Figure 1:
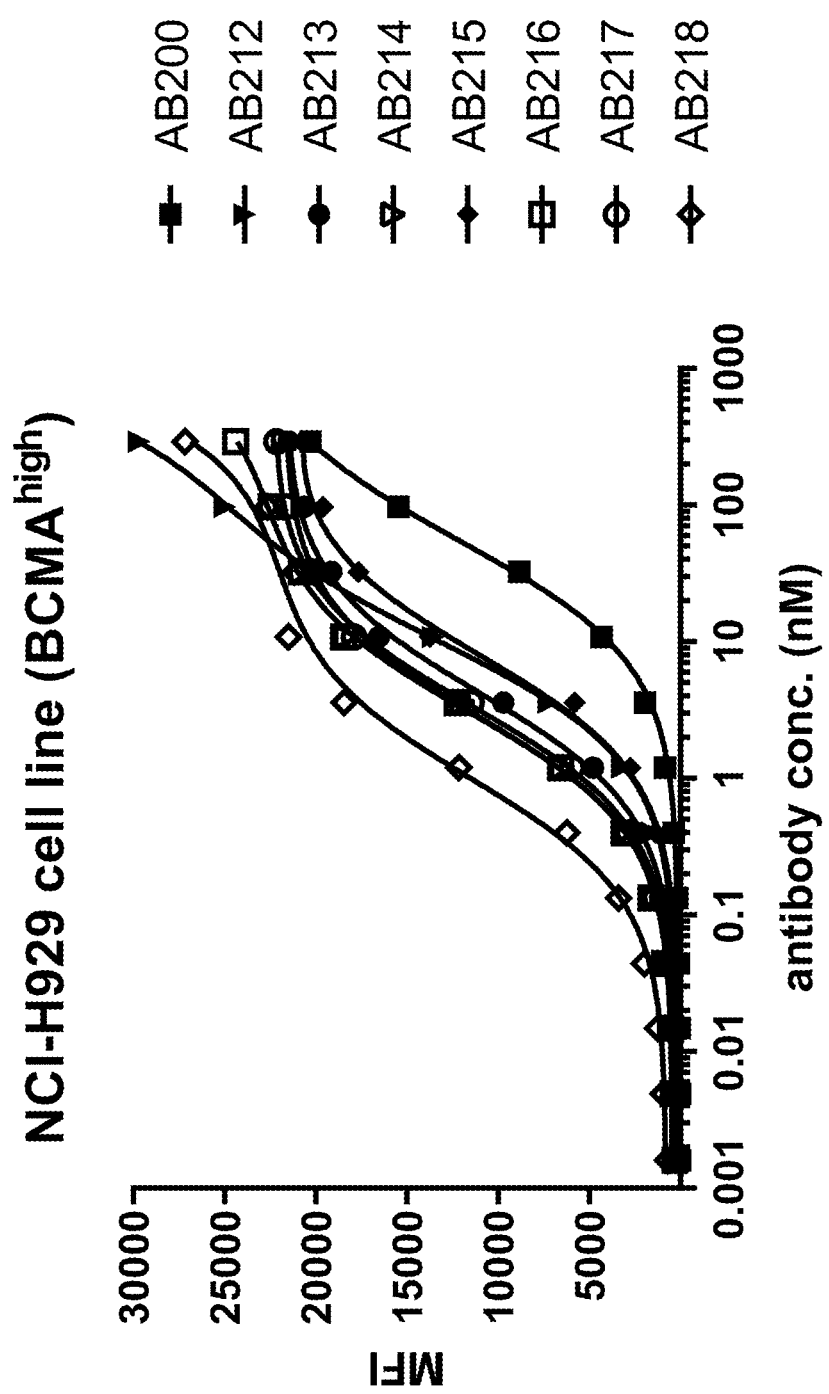
FIG. 1 shows a flow cytometric assessment of anti-BCMA antibody binding affinity on the NCI-H929 human myeloma cell line (high BCMA expression).

The disclosed compositions and methods may be understood more readily by reference to the following detailed description.

Throughout this text, the descriptions refer to compositions and methods of using the compositions. Where the disclosure describes or claims a feature or embodiment associated with a composition, such a feature or embodiment is equally applicable to the methods of using the composition. Likewise, where the disclosure describes or claims a feature or embodiment associated with a method of using a composition, such a feature or embodiment is equally applicable to the composition.

When a range of values is expressed, it includes embodiments using any particular value within the range. Further, reference to values stated in ranges includes each and every value within that range. All ranges are inclusive of their endpoints and combinable. When values are expressed as approximations, by use of the antecedent "about," it will be understood that the particular value forms another embodiment. Reference to a particular numerical value includes at least that particular value, unless the context clearly dictates otherwise. The use of "or" will mean "and/or" unless the specific context of its use dictates otherwise.

It is to be appreciated that certain features of the disclosed compositions and methods, which are, for clarity, described herein in the context of separate embodiments, may also be provided in combination in a single embodiment. Conversely, various features of the disclosed compositions and methods that are, for brevity, described in the context of a single embodiment, may also be provided separately or in any subcombination.

All references cited herein are incorporated by reference for any purpose. Where a reference and the specification conflict, the specification will control.

Various terms relating to aspects of the description are used throughout the specification and claims. Such terms are to be given their ordinary meaning in the art unless otherwise indicated. Other specifically defined terms are to be construed in a manner consistent with the definitions provided herein.

As used herein, the singular forms "a," "an," and "the" include plural forms unless the context clearly dictates otherwise.

The term "about" or "approximately" in the context of numerical values and ranges refers to values or ranges that approximate or are close to the recited values or ranges such that the embodiment may perform as intended, such as having a desired amount of nucleic acids or polypeptides in a reaction mixture, as is apparent to the skilled person from the teachings contained herein. In some embodiments, "about" means plus or minus 10% of a numerical amount.

The term "antibody" is used in the broadest sense to refer to an immunoglobulin molecule that recognizes and specifically binds to a target, such as a protein, polypeptide, carbohydrate, polynucleotide, lipid, or combinations of the foregoing through at least one antigen recognition site within the variable region of the immunoglobulin molecule. The heavy chain of an antibody is composed of a heavy chain variable region ($V_H$) and a heavy chain constant region ($C_H$). The light chain is composed of a light chain variable region ($V_L$) and a light chain constant region ($C_L$). For the purposes of this application, the mature heavy chain and light chain variable regions each comprise three complementarity determining regions (CDR1, CDR2 and CDR3) within four framework regions (FR1, FR2, FR3, and FR4) arranged from N-terminus to C-terminus: FR1, CDR1, FR2, CDR2, FR3, CDR3, and FR4. An "antibody" can be naturally occurring or man-made, such as monoclonal antibodies produced by conventional hybridoma technology. An antibody may comprise one or more than one heavy chain and/or light chain. The term "antibody" includes full-length monoclonal antibodies and full-length polyclonal antibodies, as well as antibody fragments such as Fab, Fab', F(ab')$_2$, Fv, and single chain antibodies. An antibody can be any one of the five major classes of immunoglobulins: IgA, IgD, IgE, IgG, and IgM, or subclasses thereof (e.g., isotypes IgG1, IgG2, IgG3, IgG4). The term further encompasses human antibodies, chimeric antibodies, humanized antibodies, and any modified immunoglobulin molecule containing an antigen recognition site, so long as it demonstrates one or more of the desired biological activities (e.g., binding the target antigen (e.g., BCMA), internalizing within a target antigen-expressing cell, etc.).

Numbering systems to describe the locations of CDR and FR regions in antibodies have been defined by various groups. Any of the numbering systems known in the art and/or described herein may be used to define the CDR and FR regions in the antibodies and antigen-binding fragments of the present disclosure.

In some embodiments, the antibodies and antigen-binding fragments of the present disclosure comprise CDR and FR regions as defined by the Kabat numbering system (see, e.g., Kabat et al. "Sequences of Proteins of Immunological Interest," Diane Publishing Company (1992); see also Kabat et al. "Sequences of Proteins of Immunological Interest," U.S. Department of Health and Human Services, U.S. Government Printing Office (1987 and 1991)). Exemplary CDR sequences as defined by the Kabat numbering system are set forth in Table 3 and may be used in any of the exemplary antibodies and antigen-binding fragments disclosed herein. The Kabat numbering system, in some embodiments, may also be used to describe one or more individual amino acids at positions within CDR and/or FR regions. In some embodiments, the Kabat numbering system is used in addition to, or as an alternative to, describing one or more amino acids using their absolute position in the antibody or antigen-binding fragment. In some embodiments, an amino acid and/or an amino acid modification in an antibody or antigen-binding fragment disclosed herein may be referred to by its Kabat position. For instance, in some embodiments, an antibody or antigen-binding fragment disclosed herein comprises a heavy chain variable region comprising an amino acid sequence of SEQ ID NO: 119 modified to include at least an amino acid substitution at position 103 (i.e., at absolute position 103). In some embodiments, position 103 of SEQ ID NO: 119 may be referred to by its Kabat position, i.e., as Kabat position 99 of SEQ ID NO: 119. In some embodiments, the amino acid at position 103 of SEQ ID NO: 119 (corresponding to Kabat position 99) is substituted with H.

In some embodiments, the antibodies and antigen-binding fragments of the present disclosure comprise CDR and FR regions as defined by the IMGT numbering system (International ImMunoGeneTics Information System (IMGT®)). Exemplary CDR sequences as defined by the IMGT numbering system are set forth in Table 4 and may be used in any of the exemplary antibodies and antigen-binding fragments disclosed herein.

Additional numbering systems such as the Chothia numbering system (see, e.g., Al-Lazikani et al. J Mol Biol. 1997; 273:927-48) and the Chemical Computing Group (CCG) numbering system (see, e.g., Molecular Operating Environment (MOE), 2013.08; Chemical Computing Group ULC, Montreal, QC, Canada, H3A 2R7, 2018) are known in the art may be used to define the CDR and FR regions in the antibodies and antigen-binding fragments of the present disclosure. In some embodiments, the antibodies and antigen-binding fragments of the present disclosure comprise CDR sequences that match with 100% homology to the CDR sequences described herein.

The term "monoclonal antibody," as used herein, refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic epitope. In contrast, conventional (polyclonal) antibody preparations typically include a multitude of antibodies directed against (or specific for) different epitopes. The modifier "monoclonal" indicates the character of the antibody as being obtained from a substantially homogeneous population of antibodies and is not to be construed as requiring production of the antibody by any particular method. For example, the monoclonal antibodies to be used in accordance with the present disclosure may be made by the hybridoma method first described by Kohler et al. (1975) Nature 256:495, or may be made by recombinant DNA methods (see, e.g., U.S. Pat. No. 4,816,567). Monoclonal antibodies may also be isolated from phage antibody libraries using the techniques described in Clackson et al. (1991) Nature 352:624-8, and Marks et al. (1991) J Mol Biol. 222:581-97, for example.

The monoclonal antibodies described herein specifically include "chimeric" antibodies, in which a portion of the heavy and/or light chain is identical with or homologous to corresponding sequences in antibodies derived from a particular species or belonging to a particular antibody class or subclass, while the remainder of the chain is identical or homologous to corresponding sequences in antibodies derived from another species or belonging to another antibody class or subclass, as well as fragments of such antibodies, so long as they specifically bind the target antigen and/or exhibit the desired biological activity.

The term "human antibody," as used herein, refers an antibody produced by a human or an antibody having an amino acid sequence of an antibody produced by a human.

The term "chimeric antibody," as used herein, refers to antibodies in which (a) the constant region is altered, replaced, or exchanged such that the antigen binding site (variable region) is linked to a constant region of a different or altered class, effector function, and/or species; and/or (b) the variable region, or a portion thereof, is altered, replaced, or exchanged with a variable region, or a portion thereof, having a different or altered antigen specificity. To create a chimeric antibody, in some embodiments, the variable region sequences from a non-human donor antibody (e.g., a mouse, rabbit, or rat donor antibody) can be linked to human constant regions using methods known in the art (see, e.g., U.S. Pat. No. 4,816,567 (Cabilly et al.)). For instance, a mouse anti-BCMA antibody can be modified by replacing its constant region with the constant region from a human immunoglobulin. Due to the replacement with a human constant region, the chimeric antibody can retain its specificity in recognizing human BCMA while having reduced immunogenicity in human as compared to the original mouse antibody.

As used herein, the term "humanized antibody" refers to forms of antibodies that contain at least some human sequence and at least some non-human sequence. Typically, the antibody contains human sequences and a minor portion of non-human sequences which confer binding specificity to the target antigen. Such antibodies are chimeric antibodies which contain minimal sequence derived from a non-human antibody and retain the reactivity of a non-human antibody while being less immunogenic in human. Typically, humanized antibodies are generated by replacing hypervariable region sequences from a human acceptor antibody with hypervariable region sequences from a non-human donor antibody (e.g., a mouse, rabbit, or rat donor antibody) that binds to an antigen of interest (e.g., BCMA). In some cases, framework region sequences of the acceptor antibody may also be replaced with the corresponding sequences of the donor antibody (e.g., via back mutation). In addition to the sequences derived from the donor and acceptor antibodies, the humanized antibody can be further modified by the substitution of residues, either in the framework region and/or within the replaced non-human residues to refine and optimize antibody specificity, selectivity, affinity, and/or activity, as discussed herein.

In some embodiments, the antibodies and antigen-binding fragments disclosed herein are humanized. In some embodiments, the disclosed antibodies and antigen-binding fragments contain minimal sequences derived from a non-human antibody, e.g., murine antibody CA8 (see, e.g., U.S. Pat. No. 9,273,141, which is incorporated herein by reference for exemplary non-human antibody sequences). In some embodiments, the disclosed antibodies and antigen-binding fragments retain the affinity of the non-human antibody but comprise modifications in one or more CDRs and/or frameworks. In some embodiments, the disclosed antibodies and antigen-binding fragments also exhibit one or more desirable properties not exhibited by the non-human antibody, including but not limited to lower immunogenicity and reduced toxicity. In some embodiments, the non-human antibody is a mouse antibody. In some embodiments, the non-human antibody is a mouse anti-BCMA antibody. In some embodiments, the non-human antibody, or an antigen-binding fragment or antigen-binding domain thereof, is used as a comparator or "reference" antibody, antigen binding-fragment, or antigen-binding domain, e.g., to evaluate comparative binding affinity. In other embodiments, a variant (e.g., a humanized variant) of the non-human antibody, or an antigen-binding fragment or antigen-binding domain thereof, is used as a comparator or "reference" antibody, antigen-binding fragment, or antigen-binding domain.

In some embodiments, a reference antibody, or an antigen-binding fragment or antigen-binding domain thereof, is a humanized anti-BCMA antibody comprising a heavy chain variable region comprising an amino acid sequence of SEQ ID NO: 119 and a light chain variable region comprising an amino acid sequence of SEQ ID NO: 120 (see, e.g., U.S. Pat. No. 9,273,141, which is incorporated herein by reference for exemplary reference antibody sequences). Such a reference antibody, antigen-binding fragment, and/or antigen-binding domain may be referred to herein as "AB200."

The term "antigen-binding fragment" or "antigen-binding portion" of an antibody, as used herein, refers to one or more fragments of an antibody or protein that retain the ability to specifically bind to an antigen (e.g., BCMA). Antigen-binding fragments may also retain the ability to internalize into an antigen-expressing cell. In some embodiments, antigen-binding fragments also retain immune effector activity. It has been shown that fragments of a full-length antibody can perform the antigen binding function of a full-length antibody. Examples of binding fragments encompassed within the term "antigen-binding fragment" or "antigen-binding portion" of an antibody include (i) a Fab fragment, a monovalent fragment consisting of the $V_L$, $V_H$, $C_L$, and $C_{H1}$ domains; (ii) a F(ab')$_2$ fragment, a bivalent fragment comprising two Fab fragments linked by a disulfide bridge at the hinge region; (iii) a Fd fragment consisting of the $V_H$ and $C_{H1}$ domains; (iv) a Fv fragment consisting of the $V_L$ and $V_H$ domains of a single arm of an antibody; (v) a dAb fragment, which comprises a single variable domain, e.g., a $V_H$ domain (see, e.g., Ward et al. (1989) Nature 341:544-6; and Intl. Pub. No. WO 1990/005144); and (vi) an isolated complementarity determining region (CDR). Furthermore, although the two domains of the Fv fragment, $V_L$ and $V_H$, are coded for by separate genes, they can be joined, using recombinant methods, by a synthetic linker that enables them to be made as a single protein chain in which the $V_L$ and $V_H$ regions pair to form monovalent molecules (known as single chain Fv (scFv)). See, e.g., Bird et al. (1988) Science 242:423-6; and Huston et al. (1988) Proc Natl Acad Sci. USA 85:5879-83. Such single chain antibodies are also intended to be encompassed within the term "antigen-binding fragment" or "antigen-binding portion" of an antibody, and are known in the art as an exemplary type of binding fragment that can internalize into cells upon binding (see, e.g., Zhu et al. (2010) 9:2131-41; He et al. (2010) J Nucl Med. 51:427-32; and Fitting et al. (2015) MAbs 7:390-402). In certain embodiments, scFv molecules may be incorporated into a fusion protein. Other forms of single chain antibodies, such as diabodies are also encompassed. Diabodies are bivalent, bispecific antibodies in which $V_H$ and $V_L$ domains are expressed on a single polypeptide chain, but using a linker that is too short to allow for pairing between the two domains on the same chain, thereby forcing the domains to pair with complementary domains of another chain and creating two antigen binding sites (see e.g., Holliger et al. (1993) Proc Natl Acad Sci. USA 90:6444-8; and Poljak et al. (1994) Structure 2:1121-3). Antigen-binding fragments are obtained using conventional techniques known to those of skill in the art, and the binding fragments are screened for utility (e.g., binding affinity, internalization) in the same manner as are intact antibodies. Antigen-binding fragments may be prepared by cleavage of the intact protein, e.g., by protease or chemical cleavage.

The terms "antibody-drug conjugate," "antibody conjugate," "immunoconjugate," and "ADC" are used interchangeably, and refer to one or more therapeutic compounds (e.g., a splicing modulator) that is linked to one or more antibodies or antigen-binding fragments and is defined by the generic formula: Ab-(L-D)$_p$ (Formula I), wherein Ab=an antibody or antigen-binding fragment, L=a linker moiety, D=a drug moiety (e.g., a splicing modulator), and p=the number of drug moieties per antibody or antigen-binding fragment. An ADC comprising a splicing modulator may also be referred to herein more specifically as a "splicing modulator-loaded antibody" or a "SMLA." In ADCs comprising a splicing modulator drug moiety, "p" refers to the number of splicing modulators linked to the antibody or antigen-binding fragment. In some embodiments, the linker L can include a cleavable moiety between the antibody or antigen-binding fragment and the splicing modulator. In some embodiments, the linker L can include a cleavable moiety that can be attached to either or both the antibody or antigen-binding fragment and the splicing modulator by one or more spacer units. In some embodiments, when a spacer unit attaches the cleavable moiety to the splicing modulator, it is a self-immolative spacer unit. In other embodiments, the linker L does not include a cleavable moiety and is a non-cleavable linker. In some embodiments, the linker L can include at least one spacer unit that can directly attach to the antibody or antigen-binding fragment and to the splicing modulator. Exemplary cleavable and non-cleavable linkers are described herein.

The term "internalizing" as used herein in reference to an antibody or antigen-binding fragment refers to an antibody or antigen-binding fragment that is capable of being taken through the cell's lipid bilayer membrane to an internal compartment (i.e., "internalized") upon binding to the cell, typically into a degradative compartment in the cell. For example, an internalizing anti-BCMA antibody is one that is capable of being taken into a cell after binding to BCMA on the cell membrane. In some embodiments, the antibody or antigen-binding fragment used in the ADCs disclosed herein targets a cell surface antigen (e.g., BCMA) and is an internalizing antibody or internalizing antigen-binding fragment (i.e., the ADC transfers through the cellular membrane after antigen binding). In some embodiments, the internalizing antibody or antigen-binding fragment binds a receptor on the cell surface. An internalizing antibody or internalizing antigen-binding fragment that targets a receptor on the cell membrane may induce receptor-mediated endocytosis. In some embodiments, the internalizing antibody or internalizing antigen-binding fragment is taken into the cell via receptor-mediated endocytosis.

The term "B-cell maturation antigen" or "BCMA," as used herein, refers to any native form of human BCMA. BCMA may also be referred to as "tumor necrosis factor receptor superfamily member 17 (TNFRSF17)" or "CD269." The term "BCMA" encompasses full-length BCMA (e.g., NCBI GenBank Reference Sequence: BAB60895.1; UniProt Reference Sequence: Q02223; SEQ ID NO: 106), as well as any form of human BCMA that may result from cellular expression or processing (e.g., alternative splicing events, variable promoter usage, post-transcriptional modifications, post-translational modifications, etc.). The term also encompasses functional variants or fragments of human BCMA, including but not limited to splice variants, allelic variants, and isoforms that retain one or more biologic functions of human BCMA (i.e., variants and fragments are encompassed unless the context indicates that the term is used to refer to the wild-type protein only). BCMA can be isolated from a human or may be produced recombinantly or by synthetic methods. The term may also encompass any synthetic variant to which an anti-BCMA antibody, e.g., an antibody or antigen-binding fragment disclosed herein, can specifically bind.

The term "anti-BCMA antibody" or "antibody that binds to BCMA" refers to any form of antibody or antigen-binding fragment thereof that binds, e.g., specifically binds, to BCMA. It encompasses monoclonal antibodies (including full-length monoclonal antibodies), polyclonal antibodies, and biologically functional antibody fragments so long as they bind, e.g., specifically bind, to BCMA. More specifically, in some embodiments, an anti-BCMA antibody or antigen-binding fragment disclosed herein may bind, e.g., specifically bind, to one or more amino acids in the extracellular domain of BCMA. In some embodiments, the extracellular domain of BCMA comprises amino acids 1-54 of SEQ ID NO: 106 (Table 8).

As used herein, the term "specific," "specifically binds," and "binds specifically" refers to a binding reaction between an antibody or antigen-binding fragment (e.g., an anti-BCMA antibody) and a target antigen (e.g., BCMA) in a heterogeneous population of proteins and other biologics. Antibodies can be tested for specificity of binding by comparing binding to an appropriate antigen to binding to an alternate antigen or antigen mixture under a given set of conditions. If the antibody binds to the appropriate antigen with at least 2, 5, 7, 10 or more times more affinity than to the alternate antigen or antigen mixture, then it is considered to be specific. A "specific antibody" or a "target-specific antibody" is one that only binds the target antigen (e.g., BCMA), but does not bind (or exhibits minimal binding) to other antigens. In certain embodiments, an antibody or antigen-binding fragment that specifically binds a target antigen (e.g., BCMA) also has a $K_D$ for that target of less than $1\times10^{-6}$ M, less than $1\times10^{-7}$ M, less than $1\times10^{-8}$ M, less than $1\times10^{-9}$ M, less than $1\times10^{-10}$ M, less than $1\times10^{-11}$ M, less than $1\times10^{-12}$ M, or less than $1\times10^{-13}$ M. In certain embodiments, the $K_D$ is 1 pM to 500 pM. In some embodiments, the $K_D$ is between 500 pM to 1 µM, 1 µM to 100 nM, or 100 mM to 10 nM.

The term "epitope" refers to the portion of an antigen capable of being recognized and specifically bound by an antibody. When the antigen is a polypeptide, epitopes can be formed from contiguous amino acids or noncontiguous amino acids juxtaposed by tertiary folding of the polypeptide. The epitope bound by an antibody may be identified using any epitope mapping technique known in the art, including X-ray crystallography for epitope identification by direct visualization of the antigen-antibody complex, as well as monitoring the binding of the antibody to fragments or mutated variations of the antigen, or monitoring solvent accessibility of different parts of the antibody and the antigen. Exemplary strategies used to map antibody epitopes include, but are not limited to, array-based oligo-peptide scanning, limited proteolysis, site-directed mutagenesis, high-throughput mutagenesis mapping, hydrogen-deuterium exchange, and mass spectrometry (see, e.g., Gershoni et al. (2007) 21:145-56; and Hager-Braun and Tomer (2005) Expert Rev Proteomics 2:745-56).

Competitive binding and epitope binning can also be used to determine antibodies sharing identical or overlapping epitopes. Competitive binding can be evaluated using a cross-blocking assay, such as the assay described in "Antibodies, A Laboratory Manual," Cold Spring Harbor Laboratory, Harlow and Lane ($1^{st}$ edition 1988, $2^{nd}$ edition 2014). In some embodiments, competitive binding is identified when a test antibody or binding protein reduces binding of a reference antibody or binding protein to a target antigen such as BCMA (e.g., a binding protein comprising CDRs and/or variable regions selected from those identified in Tables 3-5), by at least about 50% in the cross-blocking assay (e.g., 50%, 60%, 70%, 80%, 90%, 95%, 99%, 99.5%, or more, or any percentage in between), and/or vice versa. In some embodiments, competitive binding can be due to shared or similar (e.g., partially overlapping) epitopes, or due to steric hindrance where antibodies or binding proteins bind at nearby epitopes (see, e.g., Tzartos, Methods in Molecular Biology (Morris, ed. (1998) vol. 66, pp. 55-66)). In some embodiments, competitive binding can be used to sort groups of binding proteins that share similar epitopes. For example, binding proteins that compete for binding can be "binned" as a group of binding proteins that have overlapping or nearby epitopes, while those that do not compete are placed in a separate group of binding proteins that do not have overlapping or nearby epitopes.

The term "p" or "drug loading" or "drug:antibody ratio" or "drug-to-antibody ratio" or "DAR" refers to the number of drug moieties per antibody or antigen-binding fragment, i.e., the number of -L-D moieties per antibody or antigen-binding fragment in ADCs disclosed herein (e.g., ADCs of Formula (I)). In ADCs comprising a splicing modulator drug moiety, "p" refers to the number of splicing modulators linked to the antibody or antigen-binding fragment. For example, if two splicing modulators (e.g., two compounds each having the structure of D1) are linked to an antibody or antigen-binding fragment, p=2. In compositions comprising multiple copies of ADCs (e.g., ADCs of Formula (I)), "average p" refers to the average number of -L-D moieties per antibody or antigen-binding fragment, also referred to as "average drug loading."

A "linker" or "linker moiety" is used herein to refer to any chemical moiety that is capable of covalently joining a compound, usually a drug moiety such as a splicing modulator, to another moiety such as an antibody or antigen-binding fragment. Linkers can be susceptible to or substantially resistant to acid-induced cleavage, peptidase-induced cleavage, light-based cleavage, esterase-induced cleavage, and/or disulfide bond cleavage, at conditions under which the compound or the antibody remains active.

The term "agent" is used herein to refer to a chemical compound, a mixture of chemical compounds, a biological macromolecule, or an extract made from biological materials. The term "therapeutic agent" or "drug" refers to an agent that is capable of modulating a biological process and/or has biological activity. The splicing modulator compounds described herein are exemplary therapeutic agents.

The term "chemotherapeutic agent" or "anti-cancer agent" is used herein to refer to all agents that are effective in treating cancer regardless of mechanism of action. Inhibition of metastasis or angiogenesis is frequently a property of a chemotherapeutic agent. Chemotherapeutic agents include antibodies, biological molecules, and small molecules, and encompass the splicing modulator compounds described herein. A chemotherapeutic agent may be a cytotoxic or cytostatic agent. The term "cytostatic agent" refers to an agent that inhibits or suppresses cell growth and/or multiplication of cells. The term "cytotoxic agent" refers to a substance that causes cell death primarily by interfering with a cell's expression activity and/or functioning.

As used herein, the terms "splicing modulator," "spliceosome modulator," and "splice modulator" refer to compounds that have anti-cancer activity by interacting with components of the spliceosome. In some embodiments, a splicing modulator alters the rate or form of splicing in a target cell. Splicing modulators that function as inhibitory agents, for example, can decrease uncontrolled cellular proliferation. In some embodiments, the splicing modulators may act by binding to the SF3b spliceosome complex. Such modulators may be naturally occurring or synthetic compounds. Non-limiting examples of splicing modulators and categories of such modulators include pladienolide (e.g., pladienolide D or pladienolide B), pladienolide derivatives (e.g., pladienolide D or pladienolide B derivatives), herboxidiene, herboxidiene derivatives, spliceostatin, spliceostatin derivatives, sudemycin, and sudemycin derivatives. As used herein, the terms "derivative" and "analog" when referring to a splicing modulator, or the like, means any such compound that retains essentially the same, similar, or enhanced biological function or activity as the original compound but has an altered chemical or biological structure. In some embodiments, the splicing modulator is a pladienolide or pladienolide derivative.

As used herein, a "pladienolide derivative" refers to a compound which is structurally related to a member of the family of natural products known as the pladienolides and which retains one or more biological functions of the starting compound. Pladienolides were first identified in the bacteria *Streptomyces platensis* (Mizui et al. (2004) J Antibiot. 57:188-96) as being potently cytotoxic and resulting in cell cycle arrest in the G1 and G2/M phases of the cell cycle (e.g., Bonnal et al. (2012) Nat Rev Drug Dis. 11:847-59). There are seven naturally occurring pladienolides, pladienolide A-G (Mizui et al. (2004) J Antibiot. 57:188-96; Sakai et al. (2004) J Antibiotics. 57:180-7). U.S. Pat. Nos. 7,884,128 and 7,816,401 describe exemplary methods of synthesizing pladienolide B and D and are each incorporated herein by reference for such methods. Synthesis of pladienolide B and D may also be performed using the exemplary methods described in Kanada et al. ((2007) Angew Chem Int Ed. 46:4350-5). Kanada et al. and Intl. Pub. No. WO 2003/099813 describe exemplary methods for synthesizing E7107 (D11) (Compound 45 of WO 2003/099813) from pladienolide D (11107D of WO 2003/099813). A corresponding U.S. Pat. No. 7,550,503 to Kotake et al. Each of these references is incorporated herein for the described synthesis methods.

As used herein, a "splicing modulator drug moiety" refers to the component of an ADC or composition that provides the structure of a splicing modulator compound, e.g., the splicing modulator (D) component in an ADC of Formula (I).

As used herein, a "spliceosome" refers to a ribonucleoprotein complex that removes introns from one or more RNA segments, such as pre-mRNA segments.

The term "homolog" refers to a molecule which exhibits homology to another molecule, by for example, having sequences of chemical residues that are the same or similar at corresponding positions.

The term "inhibit" or "inhibition of," as used herein, means to reduce by a measurable amount, and can include but does not require complete prevention or inhibition.

The terms "target-negative," "target antigen-negative," and "antigen-negative" refer to the absence (or lack of a detectable level) of target antigen expression by a cell or tissue. The terms "target-positive," "target antigen-positive," and "antigen-positive" refer to the presence (or a detectable level) of target antigen expression. For example, a cell or a cell line that does not express a target antigen may be described as target-negative, whereas a cell or cell line that expresses a target antigen may be described as target-positive.

The terms "bystander killing" and "bystander effect" refer to the killing of target-negative cells in the presence of target-positive cells, wherein killing of target-negative cells is not observed in the absence of target-positive cells. Cell-to-cell contact, or at least proximity between target-positive and target-negative cells, enables bystander killing. This type of killing is distinguishable from "off-target killing," which refers to the indiscriminate killing of target-negative cells. "Off-target killing" may be observed in the absence of target-positive cells.

As used herein, the terms "cancer," "neoplasm," and "tumor" are used interchangeably and, in either the singular or plural form, refer to cells that have undergone a malignant transformation that makes them pathological to the host organism. Primary cancer cells can be readily distinguished from non-cancerous cells by well-established techniques, such as histological examination. The definition of a cancer cell, as used herein, includes not only a primary cancer cell, but any cell derived from a cancer cell ancestor. This includes metastasized cancer cells, and in vitro cultures and cell lines derived from cancer cells. A cancer may manifest as a solid tumor, e.g., a tumor detectable on the basis of tumor mass, e.g., by procedures such as computed tomography (CT) scan, magnetic resonance imaging (MRI), X-ray, ultrasound or palpation on physical examination, and/or which is detectable because of the expression of one or more cancer-specific antigens in a sample obtainable from a patient. Tumors may also be a hematopoietic (or hematologic or hematological or blood-related) cancer, for example, cancers derived from blood cells or immune cells, which may be referred to as "liquid tumors." Specific examples of clinical conditions based on hematologic tumors include leukemias such as chronic myelocytic leukemia, acute myelocytic leukemia, chronic lymphocytic leukemia, and acute lymphocytic leukemia; plasma cell malignancies such as multiple myeloma, monoclonal gammopathy of undetermined (or unknown or unclear) significance (MGUS), and Waldenström's macroglobulinemia; lymphomas such as non-Hodgkin's lymphoma and Hodgkin's lymphoma; and the like.

In some embodiments, a cancer described herein may be any hematological cancer. Hematological cancers include both lymphoid and myeloid malignancies, as well as plasma cell diseases or cancers such as multiple myeloma, MGUS, plasmacytoma (bone, extramedullary), lymphoplasmacytic lymphoma (LPL), Waldenström's macroglobulinemia, plasma cell leukemia, and primary amyloidosis (AL). Hematological cancers may also include cancers of other types of hematopoietic cells, including polymorphonuclear leukocytes (or neutrophils), basophils, eosinophils, dendritic cells, platelets, erythrocytes, and natural killer cells. Tissues which include hematopoietic cells may be referred to as "hematopoietic cell tissues" and include bone marrow; peripheral blood; thymus; and peripheral lymphoid tissues, such as spleen, lymph nodes, lymphoid tissues associated with mucosa (such as the gut-associated lymphoid tissues), tonsils, Peyer's patches and appendix, and lymphoid tissues associated with other mucosa, for example, the bronchial linings.

Particular examples of BCMA cancers described herein include plasma cell cancers. In some embodiments, the cancer is a plasma cell malignancy. In some embodiments, the plasma cell malignancy or cancer is a leukemia, lymphoma, plasmacytoma, or myeloma. In some embodiments, plasma cell malignancy or cancer is multiple myeloma, diffuse large B-cell lymphoma, mantle cell lymphoma, plasmablastic lymphoma, plasmablastic myeloma, or Burkitt's lymphoma. In some embodiments, the plasma cell malignancy or cancer is multiple myeloma. In some embodiments, the plasma cell malignancy or cancer is relapsed/refractory multiple myeloma. In some embodiments, the plasma cell malignancy or cancer comprises actively-dividing cells, dormant cells, or both. In some embodiments, the plasma cell malignancy or cancer comprises at least some dormant cells, e.g., non-dividing or slowly-dividing myeloma cells.

The term "dormant" when used to describe cells refers to cells that either are not dividing or are dividing at a slower than normal rate (e.g., a rate observed under low serum conditions). See, e.g., Khoo et al. (2019) Blood. 134(1):30-43. The term encompasses both non-dividing (quiescent) and slowly-dividing cells. The term "quiescent" refers to cells in a reversible state in which the cells do not divide but retain the ability to re-enter the process of cell division. Quiescent cells may be identified by low RNA content, lack of cell proliferation markers, and/or low cell turnover. In some embodiments, quiescent cells are quiescent cancer cells. In contrast to "dormant" cells, "actively-dividing" cells are cells that either are in the process of dividing or are actively preparing to divide at a normal rate (e.g., a rate observed under normal serum conditions).

The terms "subject" and "patient" are used interchangeably herein to refer to any animal, such as any mammal, including but not limited to, humans, non-human primates, rodents, and the like. In some embodiments, the subject or patient is a mammal. In some embodiments, the subject or patient is a human.

The term "co-administration" or administration "in combination with" one or more therapeutic agents includes concurrent administration and consecutive administration in any order.

A "pharmaceutical composition" refers to a preparation which is in such form as to permit administration and subsequently provide the intended biological activity of the active ingredient(s) and/or to achieve a therapeutic effect, and which contains no additional components which are unacceptably toxic to a subject to which the formulation would be administered. The pharmaceutical composition may be sterile.

A "pharmaceutical excipient" comprises a material such as an adjuvant, a carrier, pH-adjusting and buffering agents, tonicity adjusting agents, wetting agents, preservative, and the like.

The term "pharmaceutically acceptable" means approved or approvable by a regulatory agency of the Federal or a state government, or listed in the U.S. Pharmacopeia or other generally recognized pharmacopeia, for use in animals, and more particularly in humans.

A "pharmaceutically acceptable salt" is a salt that retains the desired biological activity of the parent compound and does not impart undesired toxicological effects. Examples of such salts are: (a) acid addition salts formed with inorganic acids, for example, hydrochloric acid, hydrobromic acid, sulfuric acid, phosphoric acid, nitric acid and the like; and salts formed with organic acids, for example, acetic acid, oxalic acid, tartaric acid, succinic acid, maleic acid, fumaric acid, gluconic acid, citric acid, malic acid, ascorbic acid, benzoic acid, tannic acid, palmitic acid, alginic acid, polyglutamic acid, naphthalenesulfonic acid, methanesulfonic acid, p-toluenesulfonic acid, naphthalenedisulfonic acid, polygalacturonic acid, and the like; and (b) salts formed from elemental anions such as chlorine, bromine, and iodine. See, e.g., Haynes et al. "Commentary: Occurrence of Pharmaceutically Acceptable Anions and Cations in the Cambridge Structural Database," J Pharmaceutical Sciences, vol. 94, no. 10 (2005), and Berge et al. "Pharmaceutical Salts," J Pharmaceutical Sciences, vol. 66, no. 1 (1977), which are incorporated by reference herein.

An "effective amount" of, e.g., an antibody, antigen-binding fragment, and/or ADC disclosed herein is an amount sufficient to perform a specifically stated purpose, for example to produce a therapeutic effect after administration, such as a reduction in tumor growth rate or tumor volume, a reduction in a symptom of cancer, or some other indicia of treatment efficacy. The term "therapeutically effective amount" refers to an amount of an antibody, antigen-binding fragment, and/or ADC effective to treat a disease or disorder in a subject. In the case of cancer, a therapeutically effective amount of an antibody, antigen-binding fragment, and/or ADC can reduce the number of cancer cells, reduce tumor size, inhibit (e.g., slow or stop) tumor metastasis, inhibit (e.g., slow or stop) tumor growth, and/or relieve one or more symptoms. A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

As used herein, the term "treat" or "treatment" or "therapeutic" (and grammatically related terms) refers to any improvement of any consequence of disease, such as prolonged survival, less morbidity, and/or a lessening of side effects which result from an alternative therapeutic modality. As is readily appreciated in the art, full eradication of disease is encompassed but not required for a treatment act. The term "treat" or "treatment," as used herein, may also refer to the administration of a described antibody, antigen-binding fragment, and/or ADC to a subject, e.g., a patient having or suspecting of having a cancer. The treatment can be to cure, heal, alleviate, relieve, alter, remedy, ameliorate, palliate, improve or affect the disease, the symptoms of the disease, or the predisposition toward the disease, e.g., a cancer. In some embodiments, in addition to treating a subject with a condition, a composition disclosed herein can also be provided prophylactically to prevent or reduce the likelihood of developing that condition.

In some embodiments, a labeled antibody, antigen-binding fragment, and/or ADC is used. Suitable "labels" include radionuclides, enzymes, substrates, cofactors, inhibitors, fluorescent moieties, chemiluminescent moieties, magnetic particles, and the like.

The term "protein," as used herein, refers to at least two covalently attached amino acids. The term encompasses polypeptides, oligopeptides, and peptides. In some embodiments, the two or more covalently attached amino acids are attached by a peptide bond. The protein may be made up of naturally occurring amino acids and peptide bonds, for example when the protein is made recombinantly using expression systems and host cells. Alternatively, the protein may include synthetic amino acids (e.g., homophenylalanine, citrulline, ornithine, and norleucine). A "recombinant protein" is a protein made using recombinant techniques using any techniques and methods known in the art, i.e., through the expression of a recombinant nucleic acid. Methods and techniques for producing recombinant proteins are well known in the art.

The terms "amino acid" and "residue," as used herein, refer to naturally occurring and synthetic amino acids, as well as amino acid analogs and amino acid mimetics that function in a manner similar to naturally occurring amino acids. Naturally occurring amino acids are those encoded by the genetic code, as well as those amino acids that are later modified in vivo, e.g., hydroxyproline, γ-carboxyglutamate, and O-phosphoserine. Amino acid analogs refer to compounds that have the same basic chemical structure as a naturally occurring amino acid, i.e., an alpha carbon that is bound to a hydrogen, a carboxyl group, an amino group, and an R group, e.g., selenocysteine, homoserine, norleucine, and methionine sulfoxide. Such analogs may have modified R groups (e.g., selenocysteine, norleucine) or modified peptide backbones (e.g., homoserine), but retain the same basic chemical structure as a naturally occurring amino acid. Amino acid mimetics refer to chemical compounds that have a structure that is different from the general chemical structure of an amino acid, but that functions in a manner similar to a naturally occurring amino acid. The three-letter and one-letter codes for exemplary amino acids are provided in Table 1.

TABLE 1

Three-letter and one-letter codes for exemplary amino acids

| Amino acid | Three-letter code | One-letter code |
|---|---|---|
| Alanine | Ala | A |
| Arginine | Arg | R |
| Asparagine | Asn | N |
| Aspartic acid | Asp | D |
| Cysteine | Cys | C |
| Glutamic acid | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |

TABLE 1-continued

Three-letter and one-letter codes for exemplary amino acids

| Amino acid | Three-letter code | One-letter code |
|---|---|---|
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

For amino acid sequences, the term "identity" or "homology" refers to a relationship between the sequences of two or more polypeptides, as determined by comparing the sequences. The term "identity" also means the degree of sequence relatedness between polypeptides, as determined by the number of matches between strings of two or more amino acid residues. The percent "identity" between the two sequences is a function of the number of identical positions shared by the sequences (i.e., percent identity equals number of identical positions/total number of positions×100), taking into account the number of gaps, and the length of each gap, which need to be introduced for optimal alignment of the two sequences. The comparison of sequences and determination of percent identity between two sequences can be accomplished using a mathematical algorithm. For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Additionally, or alternatively, the protein sequences of the present disclosure can further be used as a "query sequence" to perform a search against public databases to, for example, identify related sequences. For example, such searches can be performed using the BLAST program of Altschul et al. ((1990) J Mol Biol. 215(3):403-10).

Generally, the amino acid identity or homology between proteins disclosed herein and variants thereof, including variants of target antigens (such as BCMA) and variants of antibody variable domains (including individual variant CDRs), are at least 80% identical or homologous to the sequences depicted herein, e.g., identities or homologies of at least 85%, 90%, 91%, 92%, 93%, 94%, 95%, 96%, 97%, 98%, 99%, almost 100%, or 100%.

In a similar manner, percent "nucleic acid sequence identity" with respect to nucleic acid sequences encoding the antibodies and other proteins identified herein is defined as the percentage of nucleotide residues in a candidate sequence that are identical with the nucleotide residues in the coding sequence of the antigen-binding protein. A specific method utilizes the BLASTN module of WU-BLAST-2 set to the default parameters, with overlap span and overlap fraction set to 1 and 0.125, respectively.

Anti-BCMA Antibodies and Antigen-Binding Fragments

The present disclosure relates, in various embodiments, to antibodies and antigen-binding fragments thereof capable of binding and/or killing cancer cells (e.g., BCMA-expressing cancer cells), as well as their use in conjugates (e.g., ADCs) and therapeutic compositions.

In some embodiments, the antibodies and antigen-binding fragments disclosed herein may be used alone, administered as part of pharmaceutical compositions or combination therapies, and/or as the antibody moiety in an ADC. In some embodiments, the antibodies and antigen-binding fragments are capable of binding to BCMA. In some embodiments, the anti-BCMA antibodies and antigen-binding fragments disclosed herein are useful on their own (i.e., in unconjugated form) and as the antibody moiety in an ADC.

In some embodiments, the anti-BCMA antibodies and antigen-binding fragments disclosed herein are humanized. In some embodiments, the anti-BCMA antibodies and antigen-binding fragments contain minimal sequence derived from a non-human (e.g., mouse) antibody and retain the reactivity of the non-human antibody while being less immunogenic in human. In some embodiments, the anti-BCMA antibodies and antigen-binding fragments provide one or more improvements to binding affinity, stability, formulatability, and/or therapeutic efficacy, and/or provide reduced aggregation and/or off-target toxicity, as compared to one or more anti-BCMA antibodies known in the art.

In some embodiments, the anti-BCMA antibodies and antigen-binding fragments disclosed herein provide improved binding affinity as compared to a reference anti-BCMA antibody or antigen-binding fragment (e.g., a reference comprising AB200), whether used alone or as part of a larger molecule such as an ADC. In some embodiments, the disclosed antibodies and antigen-binding fragments have a higher affinity for BCMA (e.g., human BCMA), as compared to a reference anti-BCMA antibody or antigen-binding fragment. In some embodiments, the disclosed antibodies and antigen-binding fragments have a higher affinity for human BCMA, monkey BCMA, or both, as compared to a reference anti-BCMA antibody or antigen-binding fragment. In some embodiments, binding affinity of an antibody or antigen-binding fragment for BCMA (e.g., human BCMA and/or monkey BCMA) may be determined by, e.g., an Octet binding assay using the extracellular domain of human BCMA and/or monkey BCMA. In some embodiments, binding affinity of an antibody or antigen-binding fragment for BCMA (e.g., human BCMA) may be determined by, e.g., one or more binding assays using cancer cells having a high or moderate level of BCMA expression.

In some embodiments, the anti-BCMA antibodies and antigen-binding fragments disclosed herein provide improved stability as compared to a reference anti-BCMA antibody or antigen-binding fragment (e.g., a reference comprising AB200), whether used alone or as part of a larger molecule such as an ADC. In some embodiments, the disclosed antibodies and antigen-binding fragments exhibit increased thermostability, as compared to a reference anti-BCMA antibody or antigen-binding fragment. In some embodiments, the disclosed antibodies and antigen-binding fragments have a higher melting temperature ($T_m$), as compared to a reference anti-BCMA antibody or antigen-binding fragment. In some embodiments, stability (e.g., thermostability) of an antibody or antigen-binding fragment may be determined by, e.g., a temperature-based stability assay, e.g., differential scanning calorimetry (DSC) or a ThermoFluor assay.

By virtue of some or all of these improved properties, the disclosed antibodies and antigen-binding fragments (alone or as part of an ADC) may be useful as therapeutic agents, e.g., to treat, prevent, and/or diagnose a cancer (e.g., a BCMA-expressing cancer).

In some embodiments, the antibodies and antigen-binding fragments disclosed herein bind (e.g., specifically bind) to BCMA, e.g., as expressed on a cancer cell. The antibody or antigen-binding fragment may bind to BCMA with a dissociation constant ($K_D$) of ≤1 mM, ≤100 nM or ≤10 nM, or any amount in between, as measured by, e.g., flow cytometry analysis. In some embodiments, the $K_D$ is between 0.5 nM to 10 nM, as measured by, e.g., flow cytometry analysis.

In some embodiments, the antibody or antigen-binding fragment is a four-chain antibody (also referred to as an immunoglobulin) comprising two heavy chains and two light chains. In some embodiments, the antibody or antigen-binding fragment is a two-chain half body (one light chain and one heavy chain), or an antigen-binding fragment of an immunoglobulin. In some embodiments, the antibody or antigen-binding fragment is an antigen-binding fragment of an immunoglobulin that retains the ability to bind a target cancer antigen (e.g., BCMA) and/or provide a function of an immunoglobulin.

In some embodiments, an antibody or antigen-binding fragment disclosed herein is an internalizing antibody or internalizing antigen-binding fragment thereof. In some embodiments, the internalizing antibody or internalizing antigen-binding fragment thereof binds to a target cancer antigen expressed on the surface of a cell and enters the cell upon binding. In some embodiments, the antibody or antigen-binding fragment is attached to a splicing modulator drug moiety as an ADC and the splicing modulator drug moiety of the ADC is released from the antibody or antigen-binding fragment of the ADC after the ADC enters and is present in a cell expressing the target cancer antigen (i.e., after the ADC has been internalized), e.g., by cleavage, by degradation of the antibody or antigen-binding fragment, or by any other suitable release mechanism.

In some embodiments, an antibody or antigen-binding fragment disclosed herein may comprise a paired set of heavy and light chain variable regions taken from those listed in Table 5, or the set of six CDR sequences from the paired heavy and light chain set, e.g., a set of CDRs listed in Table 3 or 4. In some embodiments, the antibody or antigen-binding fragment further comprises human heavy and light chain frameworks (optionally with one or more back mutations to improve binding affinity) and/or human heavy and light chain constant regions or fragments thereof. For instance, the antibody or antigen-binding fragment may comprise a human IgG heavy chain constant region (such as an IgG1 or an IgG4) and a human kappa or lambda light chain constant region. In some embodiments, the antibody or antigen-binding fragment comprises a human immunoglobulin G subtype 1 (IgG1) heavy chain constant region with a human Ig kappa light chain constant region. In some embodiments, the antibody or antigen-binding fragment comprises a human IgG1 heavy chain constant region with a human Ig lambda light chain constant region. In some embodiments, the antibody or antigen-binding fragment comprises a human immunoglobulin G subtype 4 (IgG4) heavy chain constant region with a human Ig kappa light chain constant region. In some embodiments, the antibody or antigen-binding fragment comprises a human IgG4 heavy chain constant region with a human Ig lambda light chain constant region.

Amino acid sequences of exemplary antibodies of the present disclosure are set forth in Tables 3-7. Amino acid sequences of an exemplary target antigen and an exemplary reference antibody are set forth in Tables 8 and 9, respectively.

TABLE 2

Anti-BCMA Antibodies

| mAb | Type | Target |
|---|---|---|
| AB212 | humanized | BCMA |
| AB213 | humanized | BCMA |
| AB214 | humanized | BCMA |
| AB215 | humanized | BCMA |
| AB216 | humanized | BCMA |
| AB217 | humanized | BCMA |
| AB218 | humanized | BCMA |

TABLE 3

Amino acid sequences of Kabat CDRs for anti-BCMA antibodies

| mAb | Ig chain CDR | SEQ ID NO | Amino acid sequence |
|---|---|---|---|
| AB212 | HCDR1 | 1 | NYWIH |
|  | HCDR2 | 2 | GTYRSHSDTNYNQKFKS |
|  | HCDR3 | 3 | GAIYHGYDVIEN |
|  | LCDR1 | 4 | RASQSISSYLN |
|  | LCDR2 | 5 | ATSNLQI |
|  | LCDR3 | 6 | QQFRRLPWT |
| AB213 | HCDR1 | 1 | NYWIH |
|  | HCDR2 | 7 | GTYRSHSTTYYNQKFKS |
|  | HCDR3 | 8 | GAVYHGYDVIDN |
|  | LCDR1 | 9 | RASQSISSYLN |
|  | LCDR2 | 10 | ATSNLQI |
|  | LCDR3 | 11 | QQFRRLPWT |
| AB214 | HCDR1 | 1 | NYWIH |
|  | HCDR2 | 12 | ATYRSQSDTYYNQKYKS |
|  | HCDR3 | 13 | GAVYHGYDVIDN |
|  | LCDR1 | 14 | RASQSISSYLN |
|  | LCDR2 | 15 | ATSNLQI |
|  | LCDR3 | 16 | QQYRRIPWT |
| AB215 | HCDR1 | 1 | NYWIH |
|  | HCDR2 | 17 | GTYRSHSTTYYNQKFKS |
|  | HCDR3 | 18 | GAVYHGYDVIDN |
|  | LCDR1 | 19 | RASQSISSYLN |
|  | LCDR2 | 20 | ATSNLQI |
|  | LCDR3 | 21 | QQYRRIPWT |
| AB216 | HCDR1 | 1 | NYWIH |
|  | HCDR2 | 22 | ATYRIQSDTYYNQKYKS |
|  | HCDR3 | 23 | GAVYHGYDVIDN |
|  | LCDR1 | 24 | RASQSISSYIN |
|  | LCDR2 | 25 | ATSNLQI |
|  | LCDR3 | 26 | QQYRRLPWS |
| AB217 | HCDR1 | 1 | NYWIH |
|  | HCDR2 | 27 | ATYRSHSDTYYAQKYKS |
|  | HCDR3 | 28 | GAVYHGYDVIDN |
|  | LCDR1 | 29 | RASQSISSYIN |
|  | LCDR2 | 30 | ATSNLQS |
|  | LCDR3 | 31 | QQYRRIPWT |
| AB218 | HCDR1 | 1 | NYWIH |
|  | HCDR2 | 32 | ATYRSQSTTYYNQKFKS |
|  | HCDR3 | 33 | GAVYHGYDVIDN |
|  | LCDR1 | 34 | RASQSISSYLN |
|  | LCDR2 | 35 | ATSNLQI |
|  | LCDR3 | 36 | QQFRRLPWT |

TABLE 4

Amino acid sequences of IMGT CDRs for anti-BCMA antibodies

| mAb | Ig chain CDR | SEQ ID NO | Amino acid sequence |
|---|---|---|---|
| AB212 | HCDR1 | 37 | GGTFSNYW |
|  | HCDR2 | 38 | TYRSHSDT |
|  | HCDR3 | 39 | ARGAIYHGYDVIEN |
|  | LCDR1 | 40 | QSISSY |
|  | LCDR2 | 41 | ATS |
|  | LCDR3 | 42 | QQFRRLPWT |
| AB213 | HCDR1 | 43 | GGTFTNYW |
|  | HCDR2 | 44 | TYRSHSTT |
|  | HCDR3 | 45 | ARGAVYHGYDVIDN |
|  | LCDR1 | 40 | QSISSY |
|  | LCDR2 | 41 | ATS |
|  | LCDR3 | 46 | QQFRRLPWT |
| AB214 | HCDR1 | 47 | GGTFSNYW |
|  | HCDR2 | 48 | TYRSQSDT |
|  | HCDR3 | 49 | ARGAVYHGYDVIDN |
|  | LCDR1 | 40 | QSISSY |
|  | LCDR2 | 41 | ATS |
|  | LCDR3 | 50 | QQYRRIPWT |
| AB215 | HCDR1 | 51 | GGTFTNYW |
|  | HCDR2 | 52 | TYRSHSTT |
|  | HCDR3 | 53 | ARGAVYHGYDVIDN |
|  | LCDR1 | 40 | QSISSY |
|  | LCDR2 | 41 | ATS |
|  | LCDR3 | 54 | QQYRRIPWT |
| AB216 | HCDR1 | 55 | GGTFSNYW |
|  | HCDR2 | 56 | TYRIQSDT |
|  | HCDR3 | 57 | ARGAVYHGYDVIDN |
|  | LCDR1 | 40 | QSISSY |
|  | LCDR2 | 41 | ATS |
|  | LCDR3 | 58 | QQYRRLPWS |
| AB217 | HCDR1 | 59 | GGTFTNYW |
|  | HCDR2 | 60 | TYRSHSDT |
|  | HCDR3 | 61 | ARGAVYHGYDVIDN |
|  | LCDR1 | 40 | QSISSY |
|  | LCDR2 | 41 | ATS |
|  | LCDR3 | 62 | QQYRRIPWT |
| AB218 | HCDR1 | 63 | GGTFSNYW |
|  | HCDR2 | 64 | TYRSQSTT |
|  | HCDR3 | 65 | ARGAVYHGYDVIDN |
|  | LCDR1 | 40 | QSISSY |
|  | LCDR2 | 41 | ATS |
|  | LCDR3 | 66 | QQFRRLPWT |

TABLE 5

Amino acid sequences of variable regions for anti-BCMA antibodies

| mAb | Ig chain | SEQ ID NO | Amino acid sequence |
|---|---|---|---|
| AB212 | Heavy chain | 76 | QVQLVQSGAEVKKPGSSVKVSCKASGGTFSNYWIHWVRQAPGQGLEWMGGTYRSHSDTNYNQKFKSRVTITADKSTSTAYMELSSLRSEDTAVYYCARGAIYHGYDVIENWGQGTLVTVSS |
|  | Light chain | 77 | DIQMTQSPSSLSASVGDRVTITCRASQSISSYLNWYQQKPGKAPKLLIYATSNLQIGVPSRFSGSGSGTDFTLTISSLQPEDFATYYCQQFRRLPWTFGQGTKLEIK |

TABLE 5-continued

Amino acid sequences of variable regions for anti-BCMA antibodies

| mAb | Ig chain | SEQ ID NO | Amino acid sequence |
|---|---|---|---|
| AB213 | Heavy chain | 78 | QVQLVQSGAEVKKPGSSVKVSCKASGGT FTNYWIHWVRQAPGQGLEWMGGTYRSHS TTYYNQKFKSRVTITADKSTSTAYMELS SLRSEDTAVYYCARGAVYHGYDVIDNWG QGTLVTVSS |
|  | Light chain | 79 | DIQMTQSPSSLSASVGDRVTITCRASQS ISSYLNWYQQKPGKAPKLLIYATSNLQI GVPSRFSGSGSGTDFTLTISSLQPEDFA TYYCQQFRRLPWTFGQGTKLEIK |
| AB214 | Heavy chain | 80 | QVQLVQSGAEVKKPGSSVKVSCKASGGT FSNYWIHWVRQAPGQGLEWMGATYRSQS DTYYNQKYKSRVTITADKSTSTAYMELS SLRSEDTAVYYCARGAVYHGYDVIDNWG QGTLVTVSS |
|  | Light chain | 81 | DIQMTQSPSSLSASVGDRVTITCRASQS ISSYLNWYQQKPGKAPKLLIYATSNLQI GVPSRFSGSGSGTDFTLTISSLQPEDFA TYYCQQYRRIPWTFGQGTKLEIK |
| AB215 | Heavy chain | 82 | QVQLVQSGAEVKKPGSSVKVSCKASGGT FTNYWIHWVRQAPGQGLEWMGGTYRSHS TTYYNQKFKSRVTITADKSTSTAYMELS SLRSEDTAVYYCARGAVYHGYDVIDNWG QGTLVTVSS |
|  | Light chain | 83 | DIQMTQSPSSLSASVGDRVTITCRASQS ISSYLNWYQQKPGKAPKLLIYATSNLQI GVPSRFSGSGSGTDFTLTISSLQPEDFA TYYCQQYRRIPWTFGQGTKLEIK |
| AB216 | Heavy chain | 84 | QVQLVQSGAEVKKPGSSVKVSCKASGGT FSNYWIHWVRQAPGQGLEWMGATYRIQS DTYYNQKYKSRVTITADKSTSTAYMELS SLRSEDTAVYYCARGAVYHGYDVIDNWG QGTLVTVSS |
|  | Light chain | 85 | DIQMTQSPSSLSASVGDRVTITCRASQS ISSYINWYQQKPGKAPKLLIYATSNLQI GVPSRFSGSGSGTDFTLTISSLQPEDFA TYYCQQYRRLPWSFGQGTKLEIK |
| AB217 | Heavy chain | 86 | QVQLVQSGAEVKKPGSSVKVSCKASGGT FTNYWIHWVRQAPGQGLEWMGATYRSHS DTYYAQKYKSRVTITADKSTSTAYMELS SLRSEDTAVYYCARGAVYHGYDVIDNWG QGTLVTVSS |
|  | Light chain | 87 | DIQMTQSPSSLSASVGDRVTITCRASQS ISSYINWYQQKPGKAPKLLIYATSNLQS GVPSRFSGSGSGTDFTLTISSLQPEDFA TYYCQQYRRIPWTFGQGTKLEIK |
| AB218 | Heavy chain | 88 | QVQLVQSGAEVKKPGSSVKVSCKASGGT FSNYWIHWVRQAPGQGLEWMGATYRSQS TTYYNQKFKSRVTITADKSTSTAYMELS SLRSEDTAVYYCARGAVYHGYDVIDNWG QGTLVTVSS |
|  | Light chain | 89 | DIQMTQSPSSLSASVGDRVTITCRASQS ISSYLNWYQQKPGKAPKLLIYATSNLQI GVPSRFSGSGSGTDFTLTISSLQPEDFA TYYCQQFRRLPWTFGQGTKLEIK |

TABLE 6

Amino acid sequences of constant regions for anti-BCMA antibodies

| mAb | Ig chain | Class | SEQ ID NO | Amino acid sequence |
|---|---|---|---|---|
| AB212 | Heavy chain | IgG1 | 90 | ASTKGPSVFPLAPSSKSTSGGTAALG CLVKDYFPEPVTVSWNSGALTSGVHT FPAVLQSSGLYSLSSVVTVPSSSLGT QTYICNVNHKPSNTKVDKKVEPKSCD KTHTCPPCPAPELLGGPSVFLFPPKP KDTLMISRTPEVTCVVVDVSHEDPEV KFNWYVDGVEVHNAKTKPREEQYNST YRVVSVLTVLHQDWLNGKEYKCKVSN KALPAPIEKTISKAKGQPREPQVYTL PPSRDELTKNQVSLTCLVKGFYPSDI AVEWESNGQPENNYKTTPPVLDSDGS FFLYSKLTVDKSRWQQGNVFSCSVMH EALHNHYTQKSLSLSPG |
|  | Light chain | kappa | 91 | RTVAAPSVFIFPPSDEQLKSGTASVV CLLNNFYPREAKVQWKVDNALQSGNS QESVTEQDSKDSTYSLSSTLTLSKAD YEKHKVYACEVTHQGLSSPVTKSFNR GEC |
| AB213 | Heavy chain | IgG1 | 90 | ASTKGPSVFPLAPSSKSTSGGTAALG CLVKDYFPEPVTVSWNSGALTSGVHT FPAVLQSSGLYSLSSVVTVPSSSLGT QTYICNVNHKPSNTKVDKKVEPKSCD KTHTCPPCPAPELLGGPSVFLFPPKP KDTLMISRTPEVTCVVVDVSHEDPEV KFNWYVDGVEVHNAKTKPREEQYNST YRVVSVLTVLHQDWLNGKEYKCKVSN KALPAPIEKTISKAKGQPREPQVYTL PPSRDELTKNQVSLTCLVKGFYPSDI AVEWESNGQPENNYKTTPPVLDSDGS FFLYSKLTVDKSRWQQGNVFSCSVMH EALHNHYTQKSLSLSPG |

TABLE 6-continued

Amino acid sequences of constant regions for anti-BCMA antibodies

| mAb | Ig chain | Class | SEQ ID NO | Amino acid sequence |
|---|---|---|---|---|
| | Light chain | kappa | 91 | RTVAAPSVFIFPPSDEQLKSGTASVV CLLNNFYPREAKVQWKVDNALQSGNS QESVTEQDSKDSTYSLSSTLTLSKAD YEKHKVYACEVTHQGLSSPVTKSFNR GEC |
| AB214 | Heavy chain | IgG1 | 90 | ASTKGPSVFPLAPSSKSTSGGTAALG CLVKDYFPEPVTVSWNSGALTSGVHT FPAVLQSSGLYSLSSVVTVPSSSLGT QTYICNVNHKPSNTKVDKKVEPKSCD KTHTCPPCPAPELLGGPSVFLFPPKP KDTLMISRTPEVTCVVVDVSHEDPEV KFNWYVDGVEVHNAKTKPREEQYNST YRVVSVLTVLHQDWLNGKEYKCKVSN KALPAPIEKTISKAKGQPREPQVYTL PPSRDELTKNQVSLTCLVKGFYPSDI AVEWESNGQPENNYKTTPPVLDSDGS FFLYSKLTVDKSRWQQGNVFSCSVMH EALHNHYTQKSLSLSPG |
| | Light chain | kappa | 91 | RTVAAPSVFIFPPSDEQLKSGTASVV CLLNNFYPREAKVQWKVDNALQSGNS QESVTEQDSKDSTYSLSSTLTLSKAD YEKHKVYACEVTHQGLSSPVTKSFNR GEC |
| AB215 | Heavy chain | IgG1 | 90 | ASTKGPSVFPLAPSSKSTSGGTAALG CLVKDYFPEPVTVSWNSGALTSGVHT FPAVLQSSGLYSLSSVVTVPSSSLGT QTYICNVNHKPSNTKVDKKVEPKSCD KTHTCPPCPAPELLGGPSVFLFPPKP KDTLMISRTPEVTCVVVDVSHEDPEV KFNWYVDGVEVHNAKTKPREEQYNST YRVVSVLTVLHQDWLNGKEYKCKVSN KALPAPIEKTISKAKGQPREPQVYTL PPSRDELTKNQVSLTCLVKGFYPSDI AVEWESNGQPENNYKTTPPVLDSDGS FFLYSKLTVDKSRWQQGNVFSCSVMH EALHNHYTQKSLSLSPG |
| | Light chain | kappa | 91 | RTVAAPSVFIFPPSDEQLKSGTASVV CLLNNFYPREAKVQWKVDNALQSGNS QESVTEQDSKDSTYSLSSTLTLSKAD YEKHKVYACEVTHQGLSSPVTKSFNR GEC |
| AB216 | Heavy chain | IgG1 | 90 | ASTKGPSVFPLAPSSKSTSGGTAALG CLVKDYFPEPVTVSWNSGALTSGVHT FPAVLQSSGLYSLSSVVTVPSSSLGT QTYICNVNHKPSNTKVDKKVEPKSCD KTHTCPPCPAPELLGGPSVFLFPPKP KDTLMISRTPEVTCVVVDVSHEDPEV KFNWYVDGVEVHNAKTKPREEQYNST YRVVSVLTVLHQDWLNGKEYKCKVSN KALPAPIEKTISKAKGQPREPQVYTL PPSRDELTKNQVSLTCLVKGFYPSDI AVEWESNGQPENNYKTTPPVLDSDGS FFLYSKLTVDKSRWQQGNVFSCSVMH EALHNHYTQKSLSLSPG |
| | Light chain | kappa | 91 | RTVAAPSVFIFPPSDEQLKSGTASVV CLLNNFYPREAKVQWKVDNALQSGNS QESVTEQDSKDSTYSLSSTLTLSKAD YEKHKVYACEVTHQGLSSPVTKSFNR GEC |
| AB217 | Heavy chain | IgG1 | 90 | ASTKGPSVFPLAPSSKSTSGGTAALG CLVKDYFPEPVTVSWNSGALTSGVHT FPAVLQSSGLYSLSSVVTVPSSSLGT QTYICNVNHKPSNTKVDKKVEPKSCD KTHTCPPCPAPELLGGPSVFLFPPKP KDTLMISRTPEVTCVVVDVSHEDPEV KFNWYVDGVEVHNAKTKPREEQYNST YRVVSVLTVLHQDWLNGKEYKCKVSN KALPAPIEKTISKAKGQPREPQVYTL PPSRDELTKNQVSLTCLVKGFYPSDI AVEWESNGQPENNYKTTPPVLDSDGS FFLYSKLTVDKSRWQQGNVFSCSVMH EALHNHYTQKSLSLSPG |

TABLE 6-continued

Amino acid sequences of constant regions for anti-BCMA antibodies

| mAb | Ig chain | Class | SEQ ID NO | Amino acid sequence |
|---|---|---|---|---|
| | Light chain | kappa | 91 | RTVAAPSVFIFPPSDEQLKSGTASVV CLLNNFYPREAKVQWKVDNALQSGNS QESVTEQDSKDSTYSLSSTLTLSKAD YEKHKVYACEVTHQGLSSPVTKSFNR GEC |
| AB218 | Heavy chain | IgG1 | 90 | ASTKGPSVFPLAPSSKSTSGGTAALG CLVKDYFPEPVTVSWNSGALTSGVHT FPAVLQSSGLYSLSSVVTVPSSSLGT QTYICNVNHKPSNTKVDKKVEPKSCD KTHTCPPCPAPELLGGPSVFLFPPKP KDTLMISRTPEVTCVVVDVSHEDPEV KFNWYVDGVEVHNAKTKPREEQYNST YRVVSVLTVLHQDWLNGKEYKCKVSN KALPAPIEKTISKAKGQPREPQVYTL PPSRDELTKNQVSLTCLVKGFYPSDI AVEWESNGQPENNYKTTPPVLDSDGS FFLYSKLTVDKSRWQQGNVFSCSVMH EALHNHYTQKSLSLSPG |
| | Light chain | kappa | 91 | RTVAAPSVFIFPPSDEQLKSGTASVV CLLNNFYPREAKVQWKVDNALQSGNS QESVTEQDSKDSTYSLSSTLTLSKAD YEKHKVYACEVTHQGLSSPVTKSFNR GEC |

TABLE 7

Amino acid sequences of full-length Ig chains for anti-BCMA antibodies

| mAb | Ig chain | SEQ ID NO | Amino acid sequence |
|---|---|---|---|
| AB212 | Heavy chain | 92 | QVQLVQSGAEVKKPGSSVKVSCKASGGT FSNYWIHWVRQAPGQGLEWMGGTYRSHS DTNYNQKFKSRVTITADKSTSTAYMELS SLRSEDTAVYYCARGAIYHGYDVIENWG QGTLVTVSSASTKGPSVFPLAPSSKSTS GGTAALGCLVKDYFPEPVTVSWNSGALT SGVHTFPAVLQSSGLYSLSSVVTVPSSS LGTQTYICNVNHKPSNTKVDKKVEPKSC DKTHTCPPCPAPELLGGPSVFLFPPKPK DTLMISRTPEVTCVVVDVSHEDPEVKFN WYVDGVEVHNAKTKPREEQYNSTYRVVS VLTVLHQDWLNGKEYKCKVSNKALPAPI EKTISKAKGQPREPQVYTLPPSRDELTK NQVSLTCLVKGFYPSDIAVEWESNGQPE NNYKTTPPVLDSDGSFFLYSKLTVDKSR WQQGNVFSCSVMHEALHNHYTQKSLSLS PG |
| | Light chain | 93 | DIQMTQSPSSLSASVGDRVTITCRASQS ISSYLNWYQQKPGKAPKLLIYATSNLQI GVPSRFSGSGSGTDFTLTISSLQPEDFA TYYCQQFRRLPWTFGQGTKLEIKRTVAA PSVFIFPPSDEQLKSGTASVVCLLNNFY PREAKVQWKVDNALQSGNSQESVTEQDS KDSTYSLSSTLTLSKADYEKHKVYACEV THQGLSSPVTKSFNRGEC |
| AB213 | Heavy chain | 94 | QVQLVQSGAEVKKPGSSVKVSCKASGGT FTNYWIHWVRQAPGQGLEWMGGTYRSHS TTYYNQKFKSRVTITADKSTSTAYMELS SLRSEDTAVYYCARGAVYHGYDVIDNWG QGTLVTVSSASTKGPSVFPLAPSSKSTS GGTAALGCLVKDYFPEPVTVSWNSGALT SGVHTFPAVLQSSGLYSLSSVVTVPSSS LGTQTYICNVNHKPSNTKVDKKVEPKSC DKTHTCPPCPAPELLGGPSVFLFPPKPK DTLMISRTPEVTCVVVDVSHEDPEVKFN WYVDGVEVHNAKTKPREEQYNSTYRVVS VLTVLHQDWLNGKEYKCKVSNKALPAPI EKTISKAKGQPREPQVYTLPPSRDELTK NQVSLTCLVKGFYPSDIAVEWESNGQPE NNYKTTPPVLDSDGSFFLYSKLTVDKSR WQQGNVFSCSVMHEALHNHYTQKSLSLS PG |
| | Light chain | 95 | DIQMTQSPSSLSASVGDRVTITCRASQS ISSYLNWYQQKPGKAPKLLIYATSNLQI GVPSRFSGSGSGTDFTLTISSLQPEDFA TYYCQQFRRLPWTFGQGTKLEIKRTVAA PSVFIFPPSDEQLKSGTASVVCLLNNFY PREAKVQWKVDNALQSGNSQESVTEQDS KDSTYSLSSTLTLSKADYEKHKVYACEV THQGLSSPVTKSFNRGEC |
| AB214 | Heavy chain | 96 | QVQLVQSGAEVKKPGSSVKVSCKASGGT FSNYWIHWVRQAPGQGLEWMGATYRSQS DTYYNQKYKSRVTITADKSTSTAYMELS SLRSEDTAVYYCARGAVYHGYDVIDNWG QGTLVTVSSASTKGPSVFPLAPSSKSTS GGTAALGCLVKDYFPEPVTVSWNSGALT SGVHTFPAVLQSSGLYSLSSVVTVPSSS LGTQTYICNVNHKPSNTKVDKKVEPKSC DKTHTCPPCPAPELLGGPSVFLFPPKPK DTLMISRTPEVTCVVVDVSHEDPEVKFN WYVDGVEVHNAKTKPREEQYNSTYRVVS VLTVLHQDWLNGKEYKCKVSNKALPAPI EKTISKAKGQPREPQVYTLPPSRDELTK NQVSLTCLVKGFYPSDIAVEWESNGQPE NNYKTTPPVLDSDGSFFLYSKLTVDKSR WQQGNVFSCSVMHEALHNHYTQKSLSLS PG |
| | Light chain | 97 | DIQMTQSPSSLSASVGDRVTITCRASQS ISSYLNWYQQKPGKAPKLLIYATSNLQI GVPSRFSGSGSGTDFTLTISSLQPEDFA TYYCQQYRRIPWTFGQGTKLEIKRTVAA PSVFIFPPSDEQLKSGTASVVCLLNNFY PREAKVQWKVDNALQSGNSQESVTEQDS KDSTYSLSSTLTLSKADYEKHKVYACEV THQGLSSPVTKSFNRGEC |

TABLE 7-continued

Amino acid sequences of full-length Ig chains for anti-BCMA antibodies

| mAb | Ig chain | SEQ ID NO | Amino acid sequence |
|---|---|---|---|
| AB215 | Heavy chain | 98 | QVQLVQSGAEVKKPGSSVKVSCKASGGTFTNYWIHWVRQAPGQGLEWMGGTYRSHSTTYYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG |
| | Light chain | 99 | DIQMTQSPSSLSASVGDRVTITCRASQSISSYLNWYQQKPGKAPKLLIYATSNLQIGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| AB216 | Heavy chain | 100 | QVQLVQSGAEVKKPGSSVKVSCKASGGTFSNYWIHWVRQAPGQGLEWMGATYRIQSDTYYNQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG |
| | Light chain | 101 | DIQMTQSPSSLSASVGDRVTITCRASQSISSYINWYQQKPGKAPKLLIYATSNLQIGVPSRFSGSGSGTDFTLTISSLQPEDFATYYCQQYRRLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| AB217 | Heavy chain | 102 | QVQLVQSGAEVKKPGSSVKVSCKASGGTFTNYWIHWVRQAPGQGLEWMGATYRSHSDTYYAQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG |
| | Light chain | 103 | DIQMTQSPSSLSASVGDRVTITCRASQSISSYINWYQQKPGKAPKLLIYATSNLQSGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| AB218 | Heavy chain | 104 | QVQLVQSGAEVKKPGSSVKVSCKASGGTFSNYWIHWVRQAPGQGLEWMGATYRSQSTTYYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG |
| | Light chain | 105 | DIQMTQSPSSLSASVGDRVTITCRASQSISSYLNWYQQKPGKAPKLLIYATSNLQIGVPSRFSGSGSGTDFTLTISSLQPEDFATYYCQQFRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |

TABLE 8

Amino acid sequence of an exemplary target antigen

| Antigen | SEQ ID NO | Amino acid sequence |
|---|---|---|
| BCMA | 106 | MLQMAGQCSQNEYFDSLLHACIPCQLRCSSNIPPLTCQRYCNASVTNSVKGTNAILWICLGLSLIISLAVFVLMFLLRKISSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR |

* Underline indicates extracellular domain.

TABLE 9

Amino acid sequences of an exemplary reference antibody

| mAb (AB200) | SEQ ID NO | Amino acid sequence |
|---|---|---|
| HCDR1 (Kabat) | 107 | NYWMH |
| HCDR2 (Kabat) | 108 | ATYRGHSDTYYNQKFKG |
| HCDR3 (Kabat) | 109 | GAIYDGYDVLDN |
| LCDR1 (Kabat) | 110 | SASQDISNYLN |
| LCDR2 (Kabat) | 111 | YTSNLHS |
| LCDR3 (Kabat) | 112 | QQYRKLPWT |
| HCDR1 (IMGT) | 113 | GGTFSNYW |
| HCDR2 (IMGT) | 114 | TYRGHSDT |
| HCDR3 (IMGT) | 115 | ARGAIYDGYDVLDN |
| LCDR1 (IMGT) | 116 | QDISNY |
| LCDR2 (IMGT) | 117 | YTS |
| LCDR3 (IMGT) | 118 | QQYRKLPWT |
| Heavy chain variable region | 119 | QVQLVQSGAEVKKPGSSVKVSCKASGGTFSNYWMHWVRQAPGQGL EWMGATYRGHSDTYYNQKFKGRVTITADKSTSTAYMELSSLRSED TAVYYCARGAIYDGYDVLDNWGQGTLVTVSS |
| Light chain variable region | 120 | DIQMTQSPSSLSASVGDRVTITCSASQDISNYLNWYQQKPGKAPK LLIYYTSNLHSGVPSRFSGSGSGTDFTLTISSLQPEDFATYYCQQ YRKLPWTFGQGTKLE1K |
| Heavy chain constant region | 121 | ASTKGPSVFPLAPSSKSTSGGTAALGCLVKDYFPEPVTVSWNSGA LTSGVHTFPAVLQSSGLYSLSSVVTVPSSSLGTQTYICNVNHKPS NTKVDKKVEPKSCDKTHTCPPCPAPELLGGPSVFLFPPKPKDTLM ISRTPEVTCVVVDVSHEDPEVKFNWYVDGVEVHNAKTKPREEQYN STYRVVSVLTVLHQDWLNGKEYKCKVSNKALPAPIEKTISKAKGQ PREPQVYTLPPSRDELTKNQVSLTCLVKGFYPSDIAVEWESNGQP ENNYKTTPPVLDSDGSFFLYSKLTVDKSRWQQGNVFSCSVMHEAL HNHYTQKSLSLSPG |
| Light chain constant region | 122 | RTVAAPSVFIFPPSDEQLKSGTASVVCLLNNFYPREAKVQWKVDN ALQSGNSQESVTEQDSKDSTYSLSSTLTLSKADYEKHKVYACEVT HQGLSSPVTKSFNRGEC |
| Heavy chain | 123 | QVQLVQSGAEVKKPGSSVKVSCKASGGTFSNYWMHWVRQAPGQGL EWMGATYRGHSDTYYNQKFKGRVTITADKSTSTAYMELSSLRSED TAVYYCARGAIYDGYDVLDNWGQGTLVTVSSASTKGPSVFPLAPS SKSTSGGTAALGCLVKDYFPEPVTVSWNSGALTSGVHTFPAVLQS SGLYSLSSVVTVPSSSLGTQTYICNVNHKPSNTKVDKKVEPKSCD KTHTCPPCPAPELLGGPSVFLFPPKPKDTLMISRIPEVTCVVVDV SHEDPEVKFNWYVDGVEVHNAKTKPREEQYNSTYRVVSVLTVLHQ DWLNGKEYKCKVSNKALPAPIEKTISKAKGQPREPQVYTLPPSRD ELTKNQVSLTCLVKGFYPSDIAVEWESNGQPENNYKTTPPVLDSD GSFFLYSKLTVDKSRWQQGNVFSCSVMHEALHNHYTQKSLSLSPG |
| Light chain | 124 | DIQMTQSPSSLSASVGDRVTITCSASQDISNYLNWYQQKPGKAPK LLIYYTSNLHSGVPSRFSGSGSGTDFTLTISSLQPEDFATYYCQQ YRKLPWTFGQGTKLEIKRTVAAPSVFIFPPSDEQLKSGTASVVCL LNNFYPREAKVQWKVDNALQSGNSQESVTEQDSKDSTYSLSSILT LSKADYEKHKVYACEVTHQGLSSPVTKSFNRGEC |

In some embodiments, an antibody, antigen-binding fragment, or antibody moiety of an ADC disclosed herein may comprise any set of heavy and light chain variable regions listed in the tables above, or the set of six CDR sequences from the heavy and light chain set, e.g., by transplanting the six CDRs into a chosen human donor antibody framework. In some embodiments, an antibody, antigen-binding fragment, or antibody moiety of an ADC disclosed herein may comprise amino acid sequences that are homologous to the sequences listed in the tables above, so long as the antibody, antigen-binding fragment, or antibody moiety retains the ability to bind to its target cancer antigen (e.g., with a $K_D$ of less than $1 \times 10^{-8}$ M) and/or retains one or more functional properties of the antibodies, antigen-binding fragments, and antibody moieties disclosed herein (e.g., ability to internalize, modulate RNA splicing, etc.).

In some embodiments, an anti-BCMA antibody or an antigen-binding fragment thereof comprises three HCDRs comprising amino acid sequences of SEQ ID NO: 1 (HCDR1), SEQ ID NO: 2 (HCDR2), and SEQ ID NO: 3 (HCDR3); and three LCDRs comprising amino acid sequences of SEQ ID NO: 4 (LCDR1), SEQ ID NO: 5

(LCDR2), and SEQ ID NO: 6 (LCDR3), as defined by the Kabat numbering system; or three HCDRs comprising amino acid sequences of SEQ ID NO: 37 (HCDR1), SEQ ID NO: 38 (HCDR2), and SEQ ID NO: 39 (HCDR3); and three LCDRs comprising amino acid sequences of SEQ ID NO: 40 (LCDR1), SEQ ID NO: 41 (LCDR2), and SEQ ID NO: 42 (LCDR3), as defined by the IMGT numbering system.

In some embodiments, the anti-BCMA antibody or antigen-binding fragment comprises three HCDRs and three LCDRs as follows: HCDR1 consisting of SEQ ID NO: 1, HCDR2 consisting of SEQ ID NO: 2, HCDR3 consisting of SEQ ID NO: 3; and LCDR1 consisting of SEQ ID NO: 4, LCDR2 consisting of SEQ ID NO: 5, and LCDR3 consisting of SEQ ID NO: 6, as defined by the Kabat numbering system; or HCDR1 consisting of SEQ ID NO: 37, HCDR2 consisting of SEQ ID NO: 38, HCDR3 consisting of SEQ ID NO: 39; and LCDR1 consisting of SEQ ID NO: 40, LCDR2 consisting of SEQ ID NO: 41, and LCDR3 consisting of SEQ ID NO: 42, as defined by the IMGT numbering system.

In some embodiments, the anti-BCMA antibody or antigen-binding fragment comprises a heavy chain variable region comprising an amino acid sequence of SEQ ID NO: 76, and a light chain variable region comprising an amino acid sequence of SEQ ID NO: 77. In some embodiments, the anti-BCMA antibody or antigen-binding fragment comprises the heavy chain variable region amino acid sequence of SEQ ID NO: 76 and the light chain variable region amino acid sequence of SEQ ID NO: 77, or sequences that are at least 90% identical to the disclosed sequences. In some embodiments, the anti-BCMA antibody or antigen-binding fragment comprises a heavy chain variable region that is at least 90% identical to an amino acid sequence of SEQ ID NO: 76, and a light chain variable region that is at least 90% identical to an amino acid sequence of SEQ ID NO: 77. In some embodiments, the anti-BCMA antibody or antigen-binding fragment comprises a heavy chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 76; and/or a light chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 77.

In some embodiments, the anti-BCMA antibody or antigen-binding fragment comprises human heavy and light chain variable region frameworks, or human heavy and light chain variable region frameworks with one or more back mutations. In some embodiments, the anti-BCMA antibody or antigen-binding fragment is an internalizing antibody or internalizing antigen-binding fragment.

In some embodiments, the anti-BCMA antibody or antigen-binding fragment comprises a human IgG1 heavy chain constant region and/or a human Ig kappa light chain constant region. In some embodiments, the anti-BCMA antibody or antigen-binding fragment comprises a human IgG1 heavy chain constant region and/or a human Ig lambda light chain constant region. In some embodiments, the anti-BCMA antibody or antigen-binding fragment comprises a human IgG4 heavy chain constant region and/or a human Ig kappa light chain constant region. In some embodiments, the anti-BCMA antibody or antigen-binding fragment comprises a human IgG4 heavy chain constant region and/or a human Ig lambda light chain constant region. In some embodiments, the anti-BCMA antibody or antigen-binding fragment comprises a heavy chain constant region comprising an amino acid sequence of SEQ ID NO: 90, and a light chain constant region comprising an amino acid sequence of SEQ ID NO: 91. In some embodiments, the heavy chain constant region further comprises a C-terminal lysine (K).

In some embodiments, the anti-BCMA antibody or antigen-binding fragment comprises a heavy chain comprising an amino acid sequence of SEQ ID NO: 92, and a light chain comprising an amino acid sequence of SEQ ID NO: 93. In some embodiments, the anti-BCMA antibody or antigen-binding fragment comprises a heavy chain that is at least 90% identical to an amino acid sequence of SEQ ID NO: 92, and a light chain that is at least 90% identical to an amino acid sequence of SEQ ID NO: 93. In some embodiments, the anti-BCMA antibody or antigen-binding fragment comprises a heavy chain amino acid sequence that is at least 90%, at least 91%, at least 92%, at least 93%, at least 94%, at least 95%, at least 96%, at least 97%, at least 98%, at least 99%, or 100% identical to SEQ ID NO: 92; and/or a light chain amino acid sequence that is at least 90%, at least 91%, at least 92%, at least 93%, at least 94%, at least 95%, at least 96%, at least 97%, at least 98%, at least 99%, or 100% identical to SEQ ID NO: 93. In some embodiments, the heavy chain further comprises a C-terminal lysine (K). In some embodiments, the anti-BCMA antibody or antigen-binding fragment is AB212.

In some embodiments, an anti-BCMA antibody or an antigen-binding fragment thereof comprises three HCDRs comprising amino acid sequences of SEQ ID NO: 1 (HCDR1), SEQ ID NO: 7 (HCDR2), and SEQ ID NO: 8 (HCDR3); and three LCDRs comprising amino acid sequences of SEQ ID NO: 9 (LCDR1), SEQ ID NO: 10 (LCDR2), and SEQ ID NO: 11 (LCDR3), as defined by the Kabat numbering system; or three HCDRs comprising amino acid sequences of SEQ ID NO: 43 (HCDR1), SEQ ID NO: 44 (HCDR2), and SEQ ID NO: 45 (HCDR3); and three LCDRs comprising amino acid sequences of SEQ ID NO: 40 (LCDR1), SEQ ID NO: 41 (LCDR2), and SEQ ID NO: 46 (LCDR3), as defined by the IMGT numbering system.

In some embodiments, the anti-BCMA antibody or antigen-binding fragment comprises three HCDRs and three LCDRs as follows: HCDR1 consisting of SEQ ID NO: 1, HCDR2 consisting of SEQ ID NO: 7, HCDR3 consisting of SEQ ID NO: 8; and LCDR1 consisting of SEQ ID NO: 9, LCDR2 consisting of SEQ ID NO: 10, and LCDR3 consisting of SEQ ID NO: 11, as defined by the Kabat numbering system; or HCDR1 consisting of SEQ ID NO: 43, HCDR2 consisting of SEQ ID NO: 44, HCDR3 consisting of SEQ ID NO: 45; and LCDR1 consisting of SEQ ID NO: 40, LCDR2 consisting of SEQ ID NO: 41, and LCDR3 consisting of SEQ ID NO: 46, as defined by the IMGT numbering system.

In some embodiments, the anti-BCMA antibody or antigen-binding fragment comprises a heavy chain variable region comprising an amino acid sequence of SEQ ID NO: 78, and a light chain variable region comprising an amino acid sequence of SEQ ID NO: 79. In some embodiments, the anti-BCMA antibody or antigen-binding fragment comprises the heavy chain variable region amino acid sequence of SEQ ID NO: 78 and the light chain variable region amino acid sequence of SEQ ID NO: 79, or sequences that are at least 90% identical to the disclosed sequences. In some embodiments, the anti-BCMA antibody or antigen-binding fragment comprises a heavy chain variable region that is at least 90% identical to an amino acid sequence of SEQ ID NO: 78, and a light chain variable region that is at least 90% identical to an amino acid sequence of SEQ ID NO: 79. In some embodiments, the anti-BCMA antibody or antigen-binding fragment comprises a heavy chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 78; and/or a light chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 79.

In some embodiments, the anti-BCMA antibody or antigen-binding fragment comprises human heavy and light chain variable region frameworks, or human heavy and light chain variable region frameworks with one or more back mutations. In some embodiments, the anti-BCMA antibody or antigen-binding fragment is an internalizing antibody or internalizing antigen-binding fragment.

In some embodiments, the anti-BCMA antibody or antigen-binding fragment comprises a human IgG1 heavy chain constant region and/or a human Ig kappa light chain constant region. In some embodiments, the anti-BCMA antibody or antigen-binding fragment comprises a human IgG1 heavy chain constant region and/or a human Ig lambda light chain constant region. In some embodiments, the anti-BCMA antibody or antigen-binding fragment comprises a human IgG4 heavy chain constant region and/or a human Ig kappa light chain constant region. In some embodiments, the anti-BCMA antibody or antigen-binding fragment comprises a human IgG4 heavy chain constant region and/or a human Ig lambda light chain constant region. In some embodiments, the anti-BCMA antibody or antigen-binding fragment comprises a heavy chain constant region comprising an amino acid sequence of SEQ ID NO: 90, and a light chain constant region comprising an amino acid sequence of SEQ ID NO: 91. In some embodiments, the heavy chain constant region further comprises a C-terminal lysine (K).

In some embodiments, the anti-BCMA antibody or antigen-binding fragment comprises a heavy chain comprising an amino acid sequence of SEQ ID NO: 94, and a light chain comprising an amino acid sequence of SEQ ID NO: 95. In some embodiments, the anti-BCMA antibody or antigen-binding fragment comprises a heavy chain that is at least 90% identical to an amino acid sequence of SEQ ID NO: 94, and a light chain that is at least 90% identical to an amino acid sequence of SEQ ID NO: 95. In some embodiments, the anti-BCMA antibody or antigen-binding fragment comprises a heavy chain amino acid sequence that is at least 90%, at least 91%, at least 92%, at least 93%, at least 94%, at least 95%, at least 96%, at least 97%, at least 98%, at least 99%, or 100% identical to SEQ ID NO: 94; and/or a light chain amino acid sequence that is at least 90%, at least 91%, at least 92%, at least 93%, at least 94%, at least 95%, at least 96%, at least 97%, at least 98%, at least 99%, or 100% identical to SEQ ID NO: 95. In some embodiments, the heavy chain further comprises a C-terminal lysine (K). In some embodiments, the anti-BCMA antibody or antigen-binding fragment is AB213.

In some embodiments, an anti-BCMA antibody or an antigen-binding fragment thereof comprises three HCDRs comprising amino acid sequences of SEQ ID NO: 1 (HCDR1), SEQ ID NO: 12 (HCDR2), and SEQ ID NO: 13 (HCDR3); and three LCDRs comprising amino acid sequences of SEQ ID NO: 14 (LCDR1), SEQ ID NO: 15 (LCDR2), and SEQ ID NO: 16 (LCDR3), as defined by the Kabat numbering system; or three HCDRs comprising amino acid sequences of SEQ ID NO: 47 (HCDR1), SEQ ID NO: 48 (HCDR2), and SEQ ID NO: 49 (HCDR3); and three LCDRs comprising amino acid sequences of SEQ ID NO: 40 (LCDR1), SEQ ID NO: 41 (LCDR2), and SEQ ID NO: 50 (LCDR3), as defined by the IMGT numbering system.

In some embodiments, the anti-BCMA antibody or antigen-binding fragment comprises three HCDRs and three LCDRs as follows: HCDR1 consisting of SEQ ID NO: 1, HCDR2 consisting of SEQ ID NO: 12, HCDR3 consisting of SEQ ID NO: 13; and LCDR1 consisting of SEQ ID NO: 14, LCDR2 consisting of SEQ ID NO: 15, and LCDR3 consisting of SEQ ID NO: 16, as defined by the Kabat numbering system; or HCDR1 consisting of SEQ ID NO: 47, HCDR2 consisting of SEQ ID NO: 48, HCDR3 consisting of SEQ ID NO: 49; and LCDR1 consisting of SEQ ID NO: 40, LCDR2 consisting of SEQ ID NO: 41, and LCDR3 consisting of SEQ ID NO: 50, as defined by the IMGT numbering system.

In some embodiments, the anti-BCMA antibody or antigen-binding fragment comprises a heavy chain variable region comprising an amino acid sequence of SEQ ID NO: 80, and a light chain variable region comprising an amino acid sequence of SEQ ID NO: 81. In some embodiments, the anti-BCMA antibody or antigen-binding fragment comprises the heavy chain variable region amino acid sequence of SEQ ID NO: 80 and the light chain variable region amino acid sequence of SEQ ID NO: 81, or sequences that are at least 90% identical to the disclosed sequences. In some embodiments, the anti-BCMA antibody or antigen-binding fragment comprises a heavy chain variable region that is at least 90% identical to an amino acid sequence of SEQ ID NO: 80, and a light chain variable region that is at least 90% identical to an amino acid sequence of SEQ ID NO: 81. In some embodiments, the anti-BCMA antibody or antigen-binding fragment comprises a heavy chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 80; and/or a light chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 81.

In some embodiments, the anti-BCMA antibody or antigen-binding fragment comprises human heavy and light chain variable region frameworks, or human heavy and light chain variable region frameworks with one or more back mutations. In some embodiments, the anti-BCMA antibody or antigen-binding fragment is an internalizing antibody or internalizing antigen-binding fragment.

In some embodiments, the anti-BCMA antibody or antigen-binding fragment comprises a human IgG1 heavy chain constant region and/or a human Ig kappa light chain constant region. In some embodiments, the anti-BCMA antibody or antigen-binding fragment comprises a human IgG1 heavy chain constant region and/or a human Ig lambda light chain constant region. In some embodiments, the anti-BCMA antibody or antigen-binding fragment comprises a human IgG4 heavy chain constant region and/or a human Ig kappa light chain constant region. In some embodiments, the anti-BCMA antibody or antigen-binding fragment comprises a human IgG4 heavy chain constant region and/or a human Ig lambda light chain constant region. In some embodiments, the anti-BCMA antibody or antigen-binding fragment comprises a heavy chain constant region comprising an amino acid sequence of SEQ ID NO: 90, and a light chain constant region comprising an amino acid sequence of SEQ ID NO: 91. In some embodiments, the heavy chain constant region further comprises a C-terminal lysine (K).

In some embodiments, the anti-BCMA antibody or antigen-binding fragment comprises a heavy chain comprising an amino acid sequence of SEQ ID NO: 96, and a light chain comprising an amino acid sequence of SEQ ID NO: 97. In some embodiments, the anti-BCMA antibody or antigen-binding fragment comprises a heavy chain that is at least 90% identical to an amino acid sequence of SEQ ID NO: 96, and a light chain that is at least 90% identical to an amino acid sequence of SEQ ID NO: 97. In some embodiments, the anti-BCMA antibody or antigen-binding fragment comprises a heavy chain amino acid sequence that is at least 90%, at least 91%, at least 92%, at least 93%, at least 94%, at least 95%, at least 96%, at least 97%, at least 98%, at least 99%, or 100% identical to SEQ ID NO: 96; and/or a light chain amino acid sequence that is at least 90%, at least 91%, at least 92%, at least 93%, at least 94%, at least 95%, at least 96%, at least 97%, at least 98%, at least 99%, or 100% identical to SEQ ID NO: 97. In some embodiments, the heavy chain further comprises a C-terminal lysine (K). In some embodiments, the anti-BCMA antibody or antigen-binding fragment is AB214.

In some embodiments, an anti-BCMA antibody or an antigen-binding fragment thereof comprises three HCDRs comprising amino acid sequences of SEQ ID NO: 1 (HCDR1), SEQ ID NO: 17 (HCDR2), and SEQ ID NO: 18 (HCDR3); and three LCDRs comprising amino acid sequences of SEQ ID NO: 19 (LCDR1), SEQ ID NO: 20 (LCDR2), and SEQ ID NO: 21 (LCDR3), as defined by the Kabat numbering system; or three HCDRs comprising amino acid sequences of SEQ ID NO: 51 (HCDR1), SEQ ID NO: 52 (HCDR2), and SEQ ID NO: 53 (HCDR3); and three LCDRs comprising amino acid sequences of SEQ ID NO: 40 (LCDR1), SEQ ID NO: 41 (LCDR2), and SEQ ID NO: 54 (LCDR3), as defined by the IMGT numbering system.

In some embodiments, the anti-BCMA antibody or antigen-binding fragment comprises three HCDRs and three LCDRs as follows: HCDR1 consisting of SEQ ID NO: 1, HCDR2 consisting of SEQ ID NO: 17, HCDR3 consisting of SEQ ID NO: 18; and LCDR1 consisting of SEQ ID NO: 19, LCDR2 consisting of SEQ ID NO: 20, and LCDR3 consisting of SEQ ID NO: 21, as defined by the Kabat numbering system; or HCDR1 consisting of SEQ ID NO: 51, HCDR2 consisting of SEQ ID NO: 52, HCDR3 consisting of SEQ ID NO: 53; and LCDR1 consisting of SEQ ID NO: 40, LCDR2 consisting of SEQ ID NO: 41, and LCDR3 consisting of SEQ ID NO: 54, as defined by the IMGT numbering system.

In some embodiments, the anti-BCMA antibody or antigen-binding fragment comprises a heavy chain variable region comprising an amino acid sequence of SEQ ID NO: 82, and a light chain variable region comprising an amino acid sequence of SEQ ID NO: 83. In some embodiments, the anti-BCMA antibody or antigen-binding fragment comprises the heavy chain variable region amino acid sequence of SEQ ID NO: 82 and the light chain variable region amino acid sequence of SEQ ID NO: 83, or sequences that are at least 90% identical to the disclosed sequences. In some embodiments, the anti-BCMA antibody or antigen-binding fragment comprises a heavy chain variable region that is at least 90% identical to an amino acid sequence of SEQ ID NO: 82, and a light chain variable region that is at least 90% identical to an amino acid sequence of SEQ ID NO: 83. In some embodiments, the anti-BCMA antibody or antigen-binding fragment comprises a heavy chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 82; and/or a light chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 83.

In some embodiments, the anti-BCMA antibody or antigen-binding fragment comprises human heavy and light chain variable region frameworks, or human heavy and light chain variable region frameworks with one or more back mutations. In some embodiments, the anti-BCMA antibody or antigen-binding fragment is an internalizing antibody or internalizing antigen-binding fragment.

In some embodiments, the anti-BCMA antibody or antigen-binding fragment comprises a human IgG1 heavy chain constant region and/or a human Ig kappa light chain constant region. In some embodiments, the anti-BCMA antibody or antigen-binding fragment comprises a human IgG1 heavy chain constant region and/or a human Ig lambda light chain constant region. In some embodiments, the anti-BCMA antibody or antigen-binding fragment comprises a human IgG4 heavy chain constant region and/or a human Ig kappa light chain constant region. In some embodiments, the anti-BCMA antibody or antigen-binding fragment comprises a human IgG4 heavy chain constant region and/or a human Ig lambda light chain constant region. In some embodiments, the anti-BCMA antibody or antigen-binding fragment comprises a heavy chain constant region comprising an amino acid sequence of SEQ ID NO: 90, and a light chain constant region comprising an amino acid sequence of SEQ ID NO: 91. In some embodiments, the heavy chain constant region further comprises a C-terminal lysine (K).

In some embodiments, the anti-BCMA antibody or antigen-binding fragment comprises a heavy chain comprising an amino acid sequence of SEQ ID NO: 98, and a light chain comprising an amino acid sequence of SEQ ID NO: 99. In some embodiments, the anti-BCMA antibody or antigen-binding fragment comprises a heavy chain that is at least 90% identical to an amino acid sequence of SEQ ID NO: 98, and a light chain that is at least 90% identical to an amino acid sequence of SEQ ID NO: 99. In some embodiments, the anti-BCMA antibody or antigen-binding fragment comprises a heavy chain amino acid sequence that is at least 90%, at least 91%, at least 92%, at least 93%, at least 94%, at least 95%, at least 96%, at least 97%, at least 98%, at least 99%, or 100% identical to SEQ ID NO: 98; and/or a light chain amino acid sequence that is at least 90%, at least 91%, at least 92%, at least 93%, at least 94%, at least 95%, at least 96%, at least 97%, at least 98%, at least 99%, or 100% identical to SEQ ID NO: 99. In some embodiments, the heavy chain further comprises a C-terminal lysine (K). In some embodiments, the anti-BCMA antibody or antigen-binding fragment is AB215.

In some embodiments, an anti-BCMA antibody or an antigen-binding fragment thereof comprises three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system.

In some embodiments, the anti-BCMA antibody or antigen-binding fragment comprises three HCDRs and three LCDRs as follows: HCDR1 consisting of SEQ ID NO: 1, HCDR2 consisting of SEQ ID NO: 22, HCDR3 consisting of SEQ ID NO: 23; and LCDR1 consisting of SEQ ID NO: 24, LCDR2 consisting of SEQ ID NO: 25, and LCDR3 consisting of SEQ ID NO: 26, as defined by the Kabat numbering system; or HCDR1 consisting of SEQ ID NO: 55, HCDR2 consisting of SEQ ID NO: 56, HCDR3 consisting of SEQ ID NO: 57; and LCDR1 consisting of SEQ ID NO: 40, LCDR2 consisting of SEQ ID NO: 41, and LCDR3 consisting of SEQ ID NO: 58, as defined by the IMGT numbering system.

In some embodiments, the anti-BCMA antibody or antigen-binding fragment comprises a heavy chain variable region comprising an amino acid sequence of SEQ ID NO: 84, and a light chain variable region comprising an amino acid sequence of SEQ ID NO: 85. In some embodiments, the anti-BCMA antibody or antigen-binding fragment comprises the heavy chain variable region amino acid sequence of SEQ ID NO: 84 and the light chain variable region amino acid sequence of SEQ ID NO: 85, or sequences that are at least 90% identical to the disclosed sequences. In some embodiments, the anti-BCMA antibody or antigen-binding fragment comprises a heavy chain variable region that is at least 90% identical to an amino acid sequence of SEQ ID NO: 84, and a light chain variable region that is at least 90% identical to an amino acid sequence of SEQ ID NO: 85. In some embodiments, the anti-BCMA antibody or antigen-binding fragment comprises a heavy chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 84; and/or a light chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 85.

In some embodiments, the anti-BCMA antibody or antigen-binding fragment comprises human heavy and light chain variable region frameworks, or human heavy and light chain variable region frameworks with one or more back mutations. In some embodiments, the anti-BCMA antibody or antigen-binding fragment is an internalizing antibody or internalizing antigen-binding fragment.

In some embodiments, the anti-BCMA antibody or antigen-binding fragment comprises a human IgG1 heavy chain constant region and/or a human Ig kappa light chain constant region. In some embodiments, the anti-BCMA antibody or antigen-binding fragment comprises a human IgG1 heavy chain constant region and/or a human Ig lambda light chain constant region. In some embodiments, the anti-BCMA antibody or antigen-binding fragment comprises a human IgG4 heavy chain constant region and/or a human Ig kappa light chain constant region. In some embodiments, the anti-BCMA antibody or antigen-binding fragment comprises a human IgG4 heavy chain constant region and/or a human Ig lambda light chain constant region. In some embodiments, the anti-BCMA antibody or antigen-binding fragment comprises a heavy chain constant region comprising an amino acid sequence of SEQ ID NO: 90, and a light chain constant region comprising an amino acid sequence of SEQ ID NO: 91. In some embodiments, the heavy chain constant region further comprises a C-terminal lysine (K).

In some embodiments, the anti-BCMA antibody or antigen-binding fragment comprises a heavy chain comprising an amino acid sequence of SEQ ID NO: 100, and a light chain comprising an amino acid sequence of SEQ ID NO: 101. In some embodiments, the anti-BCMA antibody or antigen-binding fragment comprises a heavy chain that is at least 90% identical to an amino acid sequence of SEQ ID NO: 100, and a light chain that is at least 90% identical to an amino acid sequence of SEQ ID NO: 101. In some embodiments, the anti-BCMA antibody or antigen-binding fragment comprises a heavy chain amino acid sequence that is at least 90%, at least 91%, at least 92%, at least 93%, at least 94%, at least 95%, at least 96%, at least 97%, at least 98%, at least 99%, or 100% identical to SEQ ID NO: 100; and/or a light chain amino acid sequence that is at least 90%, at least 91%, at least 92%, at least 93%, at least 94%, at least 95%, at least 96%, at least 97%, at least 98%, at least 99%, or 100% identical to SEQ ID NO: 101. In some embodiments, the heavy chain further comprises a C-terminal lysine (K). In some embodiments, the anti-BCMA antibody or antigen-binding fragment is AB216.

In some embodiments, an anti-BCMA antibody or an antigen-binding fragment thereof comprises three HCDRs comprising amino acid sequences of SEQ ID NO: 1 (HCDR1), SEQ ID NO: 27 (HCDR2), and SEQ ID NO: 28 (HCDR3); and three LCDRs comprising amino acid sequences of SEQ ID NO: 29 (LCDR1), SEQ ID NO: 30 (LCDR2), and SEQ ID NO: 31 (LCDR3), as defined by the Kabat numbering system; or three HCDRs comprising amino acid sequences of SEQ ID NO: 59 (HCDR1), SEQ ID NO: 60 (HCDR2), and SEQ ID NO: 61 (HCDR3); and three LCDRs comprising amino acid sequences of SEQ ID NO: 40 (LCDR1), SEQ ID NO: 41 (LCDR2), and SEQ ID NO: 62 (LCDR3), as defined by the IMGT numbering system.

In some embodiments, the anti-BCMA antibody or antigen-binding fragment comprises three HCDRs and three LCDRs as follows: HCDR1 consisting of SEQ ID NO: 1, HCDR2 consisting of SEQ ID NO: 27, HCDR3 consisting of SEQ ID NO: 28; and LCDR1 consisting of SEQ ID NO: 29, LCDR2 consisting of SEQ ID NO: 30, and LCDR3 consisting of SEQ ID NO: 31, as defined by the Kabat numbering system; or HCDR1 consisting of SEQ ID NO: 59, HCDR2 consisting of SEQ ID NO: 60, HCDR3 consisting of SEQ ID NO: 61; and LCDR1 consisting of SEQ ID NO: 40, LCDR2 consisting of SEQ ID NO: 41, and LCDR3 consisting of SEQ ID NO: 62, as defined by the IMGT numbering system.

In some embodiments, the anti-BCMA antibody or antigen-binding fragment comprises a heavy chain variable region comprising an amino acid sequence of SEQ ID NO: 86, and a light chain variable region comprising an amino acid sequence of SEQ ID NO: 87. In some embodiments, the anti-BCMA antibody or antigen-binding fragment comprises the heavy chain variable region amino acid sequence of SEQ ID NO: 86 and the light chain variable region amino acid sequence of SEQ ID NO: 87, or sequences that are at least 90% identical to the disclosed sequences. In some embodiments, the anti-BCMA antibody or antigen-binding fragment comprises a heavy chain variable region that is at least 90% identical to an amino acid sequence of SEQ ID NO: 86, and a light chain variable region that is at least 90% identical to an amino acid sequence of SEQ ID NO: 87. In some embodiments, the anti-BCMA antibody or antigen-binding fragment comprises a heavy chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 86; and/or a light chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 87.

In some embodiments, the anti-BCMA antibody or antigen-binding fragment comprises human heavy and light chain variable region frameworks, or human heavy and light chain variable region frameworks with one or more back mutations. In some embodiments, the anti-BCMA antibody or antigen-binding fragment is an internalizing antibody or internalizing antigen-binding fragment.

In some embodiments, the anti-BCMA antibody or antigen-binding fragment comprises a human IgG1 heavy chain constant region and/or a human Ig kappa light chain constant region. In some embodiments, the anti-BCMA antibody or antigen-binding fragment comprises a human IgG1 heavy chain constant region and/or a human Ig lambda light chain constant region. In some embodiments, the anti-BCMA antibody or antigen-binding fragment comprises a human IgG4 heavy chain constant region and/or a human Ig kappa light chain constant region. In some embodiments, the anti-BCMA antibody or antigen-binding fragment comprises a human IgG4 heavy chain constant region and/or a human Ig lambda light chain constant region. In some embodiments, the anti-BCMA antibody or antigen-binding fragment comprises a heavy chain constant region comprising an amino acid sequence of SEQ ID NO: 90, and a light chain constant region comprising an amino acid sequence of SEQ ID NO: 91. In some embodiments, the heavy chain constant region further comprises a C-terminal lysine (K).

In some embodiments, the anti-BCMA antibody or antigen-binding fragment comprises a heavy chain comprising an amino acid sequence of SEQ ID NO: 102, and a light chain comprising an amino acid sequence of SEQ ID NO: 103. In some embodiments, the anti-BCMA antibody or antigen-binding fragment comprises a heavy chain that is at least 90% identical to an amino acid sequence of SEQ ID NO: 102, and a light chain that is at least 90% identical to an amino acid sequence of SEQ ID NO: 103. In some embodiments, the anti-BCMA antibody or antigen-binding fragment comprises a heavy chain amino acid sequence that is at least 90%, at least 91%, at least 92%, at least 93%, at least 94%, at least 95%, at least 96%, at least 97%, at least 98%, at least 99%, or 100% identical to SEQ ID NO: 102; and/or a light chain amino acid sequence that is at least 90%, at least 91%, at least 92%, at least 93%, at least 94%, at least 95%, at least 96%, at least 97%, at least 98%, at least 99%, or 100% identical to SEQ ID NO: 103. In some embodiments, the heavy chain further comprises a C-terminal lysine (K). In some embodiments, the anti-BCMA antibody or antigen-binding fragment is AB217.

In some embodiments, an anti-BCMA antibody or an antigen-binding fragment thereof comprises three HCDRs comprising amino acid sequences of SEQ ID NO: 1 (HCDR1), SEQ ID NO: 32 (HCDR2), and SEQ ID NO: 33 (HCDR3); and three LCDRs comprising amino acid sequences of SEQ ID NO: 34 (LCDR1), SEQ ID NO: 35 (LCDR2), and SEQ ID NO: 36 (LCDR3), as defined by the Kabat numbering system; or three HCDRs comprising amino acid sequences of SEQ ID NO: 63 (HCDR1), SEQ ID NO: 64 (HCDR2), and SEQ ID NO: 65 (HCDR3); and three LCDRs comprising amino acid sequences of SEQ ID NO: 40 (LCDR1), SEQ ID NO: 41 (LCDR2), and SEQ ID NO: 66 (LCDR3), as defined by the IMGT numbering system.

In some embodiments, the anti-BCMA antibody or antigen-binding fragment comprises three HCDRs and three LCDRs as follows: HCDR1 consisting of SEQ ID NO: 1, HCDR2 consisting of SEQ ID NO: 32, HCDR3 consisting of SEQ ID NO: 33; and LCDR1 consisting of SEQ ID NO: 34, LCDR2 consisting of SEQ ID NO: 35, and LCDR3 consisting of SEQ ID NO: 36, as defined by the Kabat numbering system; or HCDR1 consisting of SEQ ID NO: 63, HCDR2 consisting of SEQ ID NO: 64, HCDR3 consisting of SEQ ID NO: 65; and LCDR1 consisting of SEQ ID NO: 40, LCDR2 consisting of SEQ ID NO: 41, and LCDR3 consisting of SEQ ID NO: 66, as defined by the IMGT numbering system.

In some embodiments, the anti-BCMA antibody or antigen-binding fragment comprises a heavy chain variable region comprising an amino acid sequence of SEQ ID NO: 88, and a light chain variable region comprising an amino acid sequence of SEQ ID NO: 89. In some embodiments, the anti-BCMA antibody or antigen-binding fragment comprises the heavy chain variable region amino acid sequence of SEQ ID NO: 88 and the light chain variable region amino acid sequence of SEQ ID NO: 89, or sequences that are at least 90% identical to the disclosed sequences. In some embodiments, the anti-BCMA antibody or antigen-binding fragment comprises a heavy chain variable region that is at least 90% identical to an amino acid sequence of SEQ ID NO: 88, and a light chain variable region that is at least 90% identical to an amino acid sequence of SEQ ID NO: 89. In some embodiments, the anti-BCMA antibody or antigen-binding fragment comprises a heavy chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 88; and/or a light chain variable region amino acid sequence that is at least 90%, at least 91%, at least 92%, at least 93%, at least 94%, at least 95%, at least 96%, at least 97%, at least 98%, at least 99%, or 100% identical to SEQ ID NO: 89.

In some embodiments, the anti-BCMA antibody or antigen-binding fragment comprises human heavy and light chain variable region frameworks, or human heavy and light chain variable region frameworks with one or more back mutations. In some embodiments, the anti-BCMA antibody or antigen-binding fragment is an internalizing antibody or internalizing antigen-binding fragment.

In some embodiments, the anti-BCMA antibody or antigen-binding fragment comprises a human IgG1 heavy chain constant region and/or a human Ig kappa light chain constant region. In some embodiments, the anti-BCMA antibody or antigen-binding fragment comprises a human IgG1 heavy chain constant region and/or a human Ig lambda light chain constant region. In some embodiments, the anti-BCMA antibody or antigen-binding fragment comprises a human IgG4 heavy chain constant region and/or a human Ig kappa light chain constant region. In some embodiments, the anti-BCMA antibody or antigen-binding fragment comprises a human IgG4 heavy chain constant region and/or a human Ig lambda light chain constant region. In some embodiments, the anti-BCMA antibody or antigen-binding fragment comprises a heavy chain constant region comprising an amino acid sequence of SEQ ID NO: 90, and a light chain constant region comprising an amino acid sequence of SEQ ID NO: 91. In some embodiments, the heavy chain constant region further comprises a C-terminal lysine (K).

In some embodiments, the anti-BCMA antibody or antigen-binding fragment comprises a heavy chain comprising an amino acid sequence of SEQ ID NO: 104, and a light chain comprising an amino acid sequence of SEQ ID NO: 105. In some embodiments, the anti-BCMA antibody or antigen-binding fragment comprises a heavy chain that is at least 90% identical to an amino acid sequence of SEQ ID NO: 104, and a light chain that is at least 90% identical to an amino acid sequence of SEQ ID NO: 105. In some embodiments, the anti-BCMA antibody or antigen-binding fragment comprises a heavy chain amino acid sequence that is at least 90%, at least 91%, at least 92%, at least 93%, at least 94%, at least 95%, at least 96%, at least 97%, at least 98%, at least 99%, or 100% identical to SEQ ID NO: 104; and/or a light chain amino acid sequence that is at least 90%, at least 91%, at least 92%, at least 93%, at least 94%, at least 95%, at least 96%, at least 97%, at least 98%, at least 99%, or 100% identical to SEQ ID NO: 105. In some embodiments, the heavy chain further comprises a C-terminal lysine (K). In some embodiments, the anti-BCMA antibody or antigen-binding fragment is AB218.

The antibodies and antigen-binding fragments disclosed herein may include further modifications (e.g., one or more amino acid substitutions, deletions, and/or insertions) while maintaining the ability to bind to BCMA. In some embodiments, an antibody or antigen-binding fragment comprises specified modifications (e.g., relative to a reference antibody) and, optionally, comprises up to about 1, about 2, about 3, about 4, about 5, about 6, about 7, about 8, about 9, or about 10 amino acid modifications in addition to the specified modifications. In some embodiments, an antibody or antigen-binding fragment comprises a heavy chain variable region comprising up to about 2, up to about 5, or up to about 10 amino acid modifications (e.g., relative to a reference antibody) in addition to any specified amino acid modifications. In some embodiments, an antibody or antigen-binding fragment comprises a light chain variable region comprising up to about 2, up to about 5, or up to about 10 amino acid modifications in addition to any specified amino acid modifications.

In some embodiments, amino acid substitutions are of single residues. Insertions usually will be on the order of from about 1 to about 20 amino acid residues, although considerably larger insertions may be tolerated as long as biological function is retained (e.g., binding to BCMA). Deletions usually range from about 1 to about 20 amino acid residues, although in some cases deletions may be much larger. Substitutions, deletions, insertions, or any combination thereof may be used to arrive at a final derivative or variant. Generally, these changes are done on a few amino acids to minimize the alteration of the molecule, particularly the immunogenicity and specificity of the antigen-binding protein. However, larger changes may be tolerated in certain circumstances. Conservative substitutions are generally made in accordance with tables providing functionally similar amino acids, such as the exemplary table depicted below as Table 10 and others are known in the art.

TABLE 10

| Original Residue | Exemplary Substitutions |
|---|---|
| Ala | Ser |
| Arg | Lys |
| Asn | Gln, His |
| Asp | Glu |
| Cys | Ser |
| Gln | Asn |
| Glu | Asp |
| Gly | Pro |
| His | Asn, Gln |
| Ile | Leu, Val |
| Leu | Ile, Val |
| Lys | Arg, Gln, Glu |
| Met | Leu, Ile |
| Phe | Met, Leu, Tyr |
| Ser | Thr |
| Thr | Ser |
| Trp | Tyr |

TABLE 10-continued

| Original Residue | Exemplary Substitutions |
|---|---|
| Tyr | Trp, Phe |
| Val | Ile, Leu |

In various embodiments, substantial changes in function or immunological identity may be made by selecting substitutions that are less conservative than those shown in Table 10. For example, substitutions may be made which more significantly affect: the structure of the polypeptide backbone in the area of the alteration, for example the alpha-helical or beta-sheet structure; the charge or hydrophobicity of the molecule at the target site; or the bulk of the side chain. The substitutions which in general may produce the greatest changes in the polypeptide's properties are those in which (a) a hydrophilic residue, e.g., seryl or threonyl, is substituted for (or by) a hydrophobic residue, e.g., leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine.

In some embodiments where variant antibody sequences are used in an antibody, antigen-binding fragment, or ADC, the variants typically exhibit the same qualitative biological activity and will elicit the same immune response, although variants may also be selected to modify the characteristics of the antigen-binding proteins as needed. In addition to modifications made within the framework or CDR regions, an antibody of the disclosure may be engineered to include modifications within the Fc region, typically to alter one or more functional properties of the antibody or antigen-binding fragment, such as serum half-life, complement fixation, Fc receptor binding, and/or antigen-dependent cellular cytotoxicity. Furthermore, an antibody of the disclosure may, in some embodiments, be chemically modified (e.g., one or more chemical moieties can be attached to the antibody) or be modified to alter its glycosylation, e.g., to alter one or more functional properties of the antibody or antigen-binding fragment.

Amino acid substitutions described herein may be indicated by listing the absolute residue position followed by the three-letter or one-letter code for the substituted (i.e., replacement) amino acid. For example, the substitution of a threonine for the serine at position 30 of SEQ ID NO: 119 may be expressed as "Ser30Thr" or "S30T." In this example, serine is the "replaced" amino acid, and threonine is the "substituted" or "replacement" amino acid.

In some embodiments, amino acid substitutions described herein may be referred to using the absolute position of the substitution in the antibody or antigen-binding fragment, the Kabat numbering system, or another numbering system known in the art. Unless indicated otherwise, amino acid substitutions are referred to using the absolute position of the substitution in the antibody or antigen-binding fragment. However, in some embodiments, an amino acid substitution in an antibody or antigen-binding fragment disclosed herein may be referred to by its Kabat position. In some embodiments, an antibody or antigen-binding fragment disclosed herein comprises a heavy chain variable region comprising an amino acid sequence of SEQ ID NO: 119 modified to include at least an amino acid substitution at position 103 (i.e., at absolute position 103). In some embodiments, position 103 of SEQ ID NO: 119 may be referred to by its Kabat position, i.e., as Kabat position 99 of SEQ ID NO: 119. In some embodiments, the amino acid at position 103 of SEQ ID NO: 119 (corresponding to Kabat position 99) is substituted with H. Without being bound by theory, in some embodiments, an antibody or antigen-binding fragment comprising a histidine substituted for the aspartic acid at position 103 of SEQ ID NO: 119 (corresponding to Kabat position 99) may demonstrate higher affinity for BCMA, as compared to an antibody or antigen-binding fragment lacking the substitution. In some embodiments, a D103H (Kabat D99H) substitution may improve the binding affinity of an antibody or antigen-binding fragment for human BCMA, monkey BCMA, or both. In some embodiments, a D103H (Kabat D99H) substitution improves the binding affinity of an antibody or antigen-binding fragment for both human BCMA and monkey BCMA, as determined by, e.g., an Octet binding assay.

In some embodiments, an antibody or antigen-binding fragment disclosed herein comprises:
(a) a heavy chain variable region comprising an amino acid sequence of SEQ ID NO: 119 modified to include an amino acid substitution at one or more of positions 30, 34, 50, 54, 55, 57, 59, 61, 64, 66, 101, 103, 108, and 109; and
(b) a light chain variable region comprising an amino acid sequence of SEQ ID NO: 120 modified to include an amino acid substitution at one or more of positions 24, 28, 31, 33, 50, 55, 56, 91, 93, 94, and 97.

In some embodiments, the antibody or antigen-binding fragment comprises a heavy chain variable region comprising an amino acid sequence of SEQ ID NO: 119 modified to include an amino acid substitution at one or more of positions 30, 34, 50, 54, 55, 57, 59, 61, 64, 66, 101, 103, 108, and 109, wherein:
the amino acid at position 30 of SEQ ID NO: 119 is substituted with T;
the amino acid at position 34 of SEQ ID NO: 119 is substituted with I;
the amino acid at position 50 of SEQ ID NO: 119 is substituted with G;
the amino acid at position 54 of SEQ ID NO: 119 is substituted with S or I;
the amino acid at position 55 of SEQ ID NO: 119 is substituted with Q;
the amino acid at position 57 of SEQ ID NO: 119 is substituted with T;
the amino acid at position 59 of SEQ ID NO: 119 is substituted with N;
the amino acid at position 61 of SEQ ID NO: 119 is substituted with A;
the amino acid at position 64 of SEQ ID NO: 119 is substituted with Y;
the amino acid at position 66 of SEQ ID NO: 119 is substituted with S;
the amino acid at position 101 of SEQ ID NO: 119 is substituted with V;
the amino acid at position 103 of SEQ ID NO: 119 is substituted with H;
the amino acid at position 108 of SEQ ID NO: 119 is substituted with I; and/or
the amino acid at position 109 of SEQ ID NO: 119 is substituted with E.

In some embodiments, the antibody or antigen-binding fragment comprises a heavy chain variable region comprising an amino acid sequence of SEQ ID NO: 119 modified to include at least an amino acid substitution at position 103. In some embodiments, the amino acid at position 103 of SEQ ID NO: 119 (corresponding to Kabat position 99) is substituted with H.

In some embodiments, the antibody or antigen-binding fragment comprises a heavy chain variable region comprising an amino acid sequence of SEQ ID NO: 119 modified to include at least four amino acid substitutions. In some embodiments, the antibody or antigen-binding fragment comprises a heavy chain variable region comprising an amino acid sequence of SEQ ID NO: 119 modified to include at least amino acid substitutions at positions 34, 66, 103, and 108. In some embodiments, the amino acid at position 34 of SEQ ID NO: 119 is substituted with I; the amino acid at position 66 of SEQ ID NO: 119 is substituted with S; the amino acid at position 103 of SEQ ID NO: 119 is substituted with H; and the amino acid at position 108 of SEQ ID NO: 119 is substituted with I.

In some embodiments, the antibody or antigen-binding fragment comprises a light chain variable region comprising an amino acid sequence of SEQ ID NO: 120 modified to include an amino acid substitution at one or more of positions 24, 28, 31, 33, 50, 55, 56, 91, 93, 94, and 97, wherein:
the amino acid at position 24 of SEQ ID NO: 120 is substituted with R;
the amino acid at position 28 of SEQ ID NO: 120 is substituted with S;
the amino acid at position 31 of SEQ ID NO: 120 is substituted with S;
the amino acid at position 33 of SEQ ID NO: 120 is substituted with I;
the amino acid at position 50 of SEQ ID NO: 120 is substituted with A;
the amino acid at position 55 of SEQ ID NO: 120 is substituted with Q;
the amino acid at position 56 of SEQ ID NO: 120 is substituted with I;
the amino acid at position 91 of SEQ ID NO: 120 is substituted with F;
the amino acid at position 93 of SEQ ID NO: 120 is substituted with R;
the amino acid at position 94 of SEQ ID NO: 120 is substituted with I; and/or
the amino acid at position 97 of SEQ ID NO: 120 is substituted with S.

In some embodiments, the antibody or antigen-binding fragment comprises a light chain variable region comprising an amino acid sequence of SEQ ID NO: 120 modified to include at least six amino acid substitutions. In some embodiments, the antibody or antigen-binding fragment comprises a light chain variable region comprising an amino acid sequence of SEQ ID NO: 120 modified to include at least amino acid substitutions at positions 24, 28, 31, 50, 55, and 93. In some embodiments, the amino acid at position 24 of SEQ ID NO: 120 is substituted with R; the amino acid at position 28 of SEQ ID NO: 120 is substituted with S; the amino acid at position 31 of SEQ ID NO: 120 is substituted with S; the amino acid at position 50 of SEQ ID NO: 120 is substituted with A; the amino acid at position 55 of SEQ ID NO: 120 is substituted with Q; and the amino acid at position 93 of SEQ ID NO: 120 is substituted with R. In various embodiments, any of the modified heavy and light chains may be paired in an antibody or antigen-binding fragment or ADC disclosed herein.

In some embodiments, an antibody or antigen-binding fragment disclosed herein may be useful alone (e.g., as an antibody or antigen-binding fragment), linked to one or more additional agents (e.g., as ADCs), or as part of a larger macromolecule (e.g., a bispecific antibody or multispecific antibody). For instance, in some embodiments, the antibody or antigen-binding fragment is an antigen-binding domain in and/or is part of a bispecific or multispecific antibody. In some embodiments, an antigen-binding domain is an antigen-binding fragment. In some embodiments, the antigen-binding domain and/or antigen-binding fragment is a single chain variable fragment (scFv) or a Fab fragment. In some embodiments, the antibodies and antigen-binding fragments disclosed herein, for use alone or as part of a larger macromolecule, may include further modifications (e.g., one or more amino acid substitutions, deletions, and/or insertions) while retaining BCMA-binding function.

In some embodiments, an antibody or antigen-binding fragment disclosed herein is conjugated to a therapeutic agent. In some embodiments, the therapeutic agent is a splicing modulator. In some embodiments, the therapeutic agent is a pladienolide or a pladienolide derivative. In some embodiments, the therapeutic agent is pladienolide D or a pladienolide D derivative. In some embodiments, the therapeutic agent is D1, D2, or another exemplary splicing modulator described or incorporated by reference herein. In some embodiments, the therapeutic agent is D1. In some embodiments, the therapeutic agent is D2.

In some embodiments, the present disclosure provides isolated and/or substantially purified nucleic acid molecules (also referred to as polynucleotides) which encode full-length polypeptides or polypeptides comprising segments of the antibodies and antigen-binding fragments described herein. As used herein, "isolated" means removed from one or more components found in the normal environment of a nucleic acid, prior to intervention. In some embodiments, a single nucleic acid may comprise both the coding sequence for a heavy chain variable region and a light chain variable region, and optionally also comprise coding sequences for one or more constant regions, of an antibody or antigen-binding fragment disclosed herein. Alternatively, some or all of these coding sequences may reside on separate nucleic acid molecules. When expressed from appropriate expression vectors, polypeptides encoded by these polynucleotides are capable of binding to BCMA (e.g., human BCMA).

Also provided herein are polynucleotides which encode at least one CDR region, and usually all three CDR regions, from the heavy and/or light chain of an exemplary anti-BCMA antibody or antigen-binding fragment of the disclosure. Further provided herein are polynucleotides which encode all or substantially all of the variable region sequence of the heavy chain and/or the light chain of an exemplary anti-BCMA antibody or antigen-binding fragment of the disclosure. Because of the degeneracy of the genetic code, a variety of nucleic acid sequences will encode each of the exemplary amino acid sequences disclosed herein.

Also provided herein are expression vectors, host cells, and methods for producing the anti-BCMA antibodies and antigen-binding fragments of the disclosure.

An exemplary embodiment is an isolated nucleic acid encoding an antibody or antigen-binding fragment disclosed herein. Another exemplary embodiment is an isolated vector comprising an isolated nucleic acid encoding an antibody or antigen-binding fragment disclosed herein. Another exemplary embodiment is an isolated cell or cell population comprising an isolated nucleic acid, or a vector comprising an isolated nucleic acid, encoding an antibody or antigen-binding fragment disclosed herein. Another exemplary embodiment is a method of producing an antibody or antigen-binding fragment by culturing a host cell or cell population modified to comprise one or more nucleic acid sequences encoding an antibody or antigen-binding fragment described herein under conditions suitable to produce the antibody or antigen-binding fragment. In some embodiments, the method further comprises a step of isolating, purifying, and/or recovering the produced antibody or antigen-binding fragment.

The term "vector" is intended to refer to a polynucleotide molecule capable of transporting and/or controlling the expression of another polynucleotide to which it has been linked. One type of vector is a "plasmid," which refers to a circular double-stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors can direct the expression of genes to which they are operatively linked. Such vectors are referred to herein as "expression vectors" or "recombinant expression vectors." In general, expression vectors of utility in recombinant DNA techniques are often in the form of plasmids. The present disclosure is intended to include plasmids, as well as other forms of expression vectors, such as viral vectors (e.g., replication defective retroviruses or lentiviruses, adenoviruses, and adeno-associated viruses), which serve equivalent functions.

Vectors to be used to receive sequences encoding anti-BCMA antibody heavy and/or light chain variable regions sometimes also encode constant regions or parts thereof. Such vectors allow expression of the variable regions as fusion proteins with the constant regions, thereby leading to production of full-length antibodies or antigen-binding fragments thereof. In general, such constant regions are human. In some embodiments, the constant region is a human IgG1 heavy chain constant region. In some embodiments, the constant region is a human IgG4 heavy chain constant region. In some embodiments, the constant region is a human Ig kappa light chain constant region. In some embodiments, the constant region is a human Ig lambda light chain constant region.

The term "host cell" refers to a cell (or cell population) artificially engineered to comprise nucleic acids encoding the sequence of a peptide and which will transcribe and translate, and optionally, secrete the peptide into the cell growth medium. For recombinant production purposes, a nucleic acid encoding the amino acid sequence of the peptide would typically be synthesized or cloned by conventional methods and integrated into an expression vector. The term "host cell" refers not only to the particular subject cell but to the progeny of such a cell. Because certain modifications may occur in succeeding generations due to either mutation or environmental influences, such progeny may not, in fact, be identical to the parent cell, but are still included within the scope of the term as used herein.

The host cells for harboring and expressing nucleic acids encoding anti-BCMA antibody chains or antigen-binding fragments can be either prokaryotic or eukaryotic. In some embodiments, mammalian host cells are used to express and produce the anti-BCMA polypeptides of the present disclosure. For example, they can be either a hybridoma cell line expressing endogenous immunoglobulin genes or a mammalian cell line harboring an exogenous expression vector.

These include any normal mortal or normal or abnormal immortal animal or human cell. For example, a number of suitable host cell lines capable of secreting intact immunoglobulins have been developed including the CHO cell lines, various COS cell lines, HeLa cells, myeloma cell lines, transformed B cells, and hybridomas. Exemplary host cells include but are not limited to Chinese hamster ovary (CHO) cells, human embryonic kidney (HEK) cells (e.g., 293T), monkey kidney (COS) cells (e.g., COS-1, COS-7), baby hamster kidney (BHK) cells (e.g., BHK-21), African green monkey kidney cells (e.g. BSC-1), HeLa cells, human hepatocellular carcinoma cells (e.g., Hep G2), myeloma cells (e.g., NS0, 653, SP2/0), and lymphoma cells, or any derivative, immortalized, or transformed cell thereof.

In some embodiments, one or more nucleic acid molecules encoding the heavy and/or light chains of an anti-BCMA antibody or antigen-binding fragment, or one or more expression vectors comprising such nucleic acid molecules, can be introduced into a suitable host cell to create a recombinant host cell using any method appropriate to the host cell selected (e.g., transformation, transfection, electroporation, infection), such that the nucleic acid molecules are operably linked to one or more expression control elements (e.g., in a vector, in a construct created by processes in the cell, integrated into the host cell genome). In some embodiments, the resulting recombinant host cell can be maintained under conditions suitable for expression or production (e.g., in the presence of an inducer, in a suitable non-human animal, in suitable culture media supplemented with appropriate salts, growth factors, antibiotics, nutritional supplements, etc.), whereby the encoded polypeptides are produced. If desired, the encoded protein can be isolated or recovered (e.g., from the animal, the host cell, medium). This process encompasses expression in a host cell of a transgenic non-human animal (see, e.g., Intl. Pub. No. WO 1992/003918). Further, expression of antibody chains or antigen-binding fragments from production cell lines can be enhanced using known techniques. For example, the glutamine synthetase and DHFR gene expression systems are common approaches for enhancing expression under certain conditions. High expressing cell clones can be identified using conventional techniques, such as limited dilution cloning, gel micro-drop technology, or any other methods known in the art.

Antibody-Drug Conjugates

The antibody-drug conjugates (ADCs) of the present disclosure include those with anti-cancer activity. In particular, the ADCs include an antibody or antigen-binding fragment conjugated (e.g., covalently attached by a linker) to a drug moiety (e.g., a splicing modulator), wherein the drug moiety when not conjugated to an antibody or antigen-binding fragment has a cytotoxic or cytostatic effect. In various embodiments, the drug moiety when not conjugated to an antibody or antigen-binding fragment is capable of binding to and/or interacting with the SF3b spliceosome complex. In various embodiments, the drug moiety when not conjugated to an antibody or antigen-binding fragment is capable of modulating in vitro and/or in vivo RNA splicing. By targeting RNA splicing, in various embodiments, the drug moieties and ADCs disclosed herein provide potent anti-proliferative agents. In various embodiments, the drug moieties and ADCs disclosed herein can target both actively-dividing and dormant cells (e.g., actively-dividing, non-dividing, and/or slowly-dividing myeloma cells).

In various embodiments, the present disclosure is based, at least in part, on the discovery that the novel antibodies and antigen-binding fragments disclosed herein may provide improved properties when linked to certain biologically active splicing modulators and used in ADCs. While a splicing modulator may show desirably improved features (e.g., robust SF3b spliceosome complex binding, potent modulation of RNA splicing) when used on its own, it may have limited ability to preferentially target diseased tissue. Also, in various embodiments, the splicing modulator may exhibit fewer of its desirable features when conjugated to some antibodies or antigen-binding fragments. Thus, the development and production of an ADC for use as a human therapeutic agent, e.g., as an oncologic agent, may require more than the identification of an antibody capable of binding to a desired target or targets and attaching to a drug used on its own to treat cancer. Linking the antibody to the drug may have significant effects on the activity of one or both of the antibody and the drug, effects which will vary depending on the type of linker and/or drug chosen. In some embodiments, therefore, the components of the ADC are selected to (i) retain one or more therapeutic properties exhibited by the antibody and drug moieties in isolation, (ii) maintain the specific binding properties of the antibody or antigen-binding fragment; (iii) optimize drug loading and drug-to-antibody ratios; (iv) allow delivery, e.g., intracellular delivery, of the drug moiety via stable attachment to the antibody or antigen-binding fragment; (v) retain ADC stability as an intact conjugate until transport or delivery to a target site; (vi) minimize aggregation of the ADC prior to or after administration; (vii) allow for the therapeutic effect, e.g., cytotoxic effect, of the drug moiety after cleavage or other release mechanism in the cellular environment; (viii) exhibit in vivo anti-cancer treatment efficacy comparable to or superior to that of the antibody and drug moieties in isolation; (ix) minimize off-target killing by the drug moiety; and/or (x) exhibit desirable pharmacokinetic and pharmacodynamics properties, formulatability, and toxicologic/immunologic profiles. Some or each of these properties may be needed to identify an improved ADC for therapeutic use (Ab et al. (2015) Mol Cancer Ther. 14:1605-13).

In various embodiments, the ADCs disclosed herein exhibit unexpectedly favorable properties in some or each of the categories listed above. For instance, in some embodiments, the ADC constructs disclosed herein exhibit surprisingly favorable drug loading, aggregation, and/or stability profiles, and/or preserve or improve antibody binding function, drug activity, and/or bystander killing activity, while reducing off-target killing, as compared to ADCs comprising an alternate antibody, linker, and/or drug moiety (e.g., an alternate antibody (e.g., a reference antibody) and/or an alternate splicing modulator). In some embodiments, the ADC constructs disclosed herein exhibit improved cytotoxic and/or cytostatic activity against non-dividing and/or slowly-dividing cells, as compared to ADCs comprising an alternate antibody, linker, and/or drug moiety (e.g., an alternate antibody (e.g., a reference antibody) and/or an alternate splicing modulator). In some embodiments, the ADC constructs disclosed herein demonstrate higher affinity for BCMA and/or superior stability, activity, potency, or other effect (measured in vivo or in vitro), as compared to ADCs using an alternate antibody, linker, and/or drug moiety (e.g., an alternate antibody (e.g., a reference antibody) and/or an alternate splicing modulator). In some embodiments, a comparator or reference ADC is an ADC comprising the same linker and/or splicing modulator payload but an alternate antibody (e.g., AB200 or other exemplary anti-BCMA antibody).

In some embodiments, the ADC constructs disclosed herein demonstrate improved binding affinity, as compared to, e.g., an ADC comprising the same linker and/or splicing modulator payload but an alternate antibody (e.g., AB200 or other exemplary anti-BCMA antibody). In some embodiments, a disclosed ADC has a higher affinity for BCMA (e.g., human BCMA), as compared to an ADC comprising the same linker and/or splicing modulator payload but an alternate antibody. In some embodiments, a disclosed ADC comprises an exemplary anti-BCMA antibody or antigen-binding fragment, a linker, and a splicing modulator payload. In some embodiments, the anti-BCMA antibody or antigen-binding fragment is any one of antibodies AB212, AB213, AB214, AB215, AB216, AB217, or AB218 (e.g., AB212 or AB216, e.g., AB216). In some embodiments, the reference ADC is an ADC comprising the same linker and the same splicing modulator payload as the disclosed ADC (e.g., ADL1-D2) but an alternate antibody (e.g., AB200). In some embodiments, binding affinity of an ADC for BCMA (e.g., human BCMA) may be determined by, e.g., one or more binding assays using cancer cells having a high or moderate level of BCMA expression.

In some embodiments, the ADC constructs disclosed herein demonstrate improved cytotoxic and/or cytostatic activity, as compared to, e.g., an ADC comprising the same linker and/or splicing modulator payload but an alternate antibody (e.g., AB200 or other exemplary anti-BCMA antibody). In some embodiments, a disclosed ADC exhibits increased potency against BCMA-expressing cells (e.g., NCI-H929 and/or OPM2 cells), as compared to an ADC comprising the same linker and/or splicing modulator payload but an alternate antibody. In some embodiments, a disclosed ADC does not depend on the cell cycle for activity. In some embodiments, a disclosed ADC retains cytotoxic and/or cytostatic activity independent of cell proliferation status. In some embodiments, a disclosed ADC can target both actively-dividing and dormant cells. In some embodiments, a disclosed ADC exhibits increased potency against dormant cells (e.g., non-dividing and/or slowly-dividing myeloma cells), as compared to an alternate anti-BCMA ADC (e.g., an anti-BCMA ADC comprising an alternate antibody, linker, and/or payload, e.g., AB200-ADL10-MMAF). In some embodiments, a disclosed ADC does not inhibit the growth of and/or kill cells that do not express BCMA (e.g., BCMA-negative cells, e.g., Jurkat cells). In some embodiments, a disclosed ADC comprises an exemplary anti-BCMA antibody or antigen-binding fragment, a linker, and a splicing modulator payload. In some embodiments, the anti-BCMA antibody or antigen-binding fragment is any one of antibodies AB212, AB213, AB214, AB215, AB216, AB217, or AB218 (e.g., AB212 or AB216, e.g., AB216). In some embodiments, the reference ADC is an ADC comprising the same linker and the same splicing modulator payload as the disclosed ADC but an alternate antibody (e.g., AB200). In some embodiments, cytotoxic and/or cytostatic activity of an ADC may be determined by, e.g., in vitro activity assays using cancer cells having a high or moderate level of BCMA expression.

In some embodiments, the ADC constructs disclosed herein demonstrate improved in vivo anti-cancer activity, as compared to, e.g., an ADC comprising the same linker and/or splicing modulator payload but an alternate antibody (e.g., AB200 or other exemplary anti-BCMA antibody). In some embodiments, a disclosed ADC exhibits increased tumor growth inhibition against BCMA-expressing tumors (e.g., OPM2 and/or MOLP8 tumors), as compared to an ADC comprising the same linker and/or splicing modulator payload but an alternate antibody. In some embodiments, a disclosed ADC comprises an exemplary anti-BCMA antibody or antigen-binding fragment, a linker, and a splicing modulator payload. In some embodiments, the anti-BCMA antibody or antigen-binding fragment is any one of antibodies AB212, AB213, AB214, AB215, AB216, AB217, or AB218 (e.g., AB212 or AB216, e.g., AB216). In some embodiments, the reference ADC is an ADC comprising the same linker and the same splicing modulator payload as the disclosed ADC (e.g., ADL1-D2) but an alternate antibody (e.g., AB200). In some embodiments, in vivo anti-cancer activity of an ADC may be determined by, e.g., activity assays in xenograft models having a high or moderate level of BCMA expression.

In some embodiments, the ADC constructs disclosed herein demonstrate desirable properties for a therapeutic ADC. In some embodiments, these properties include, but are not limited to, effective levels of drug loading, low aggregation levels, stability, retained affinity for BCMA-expressing cells comparable to unconjugated antibody, potent cytotoxicity against BCMA-expressing cells, low levels of off-target cell killing, and/or effective in vivo anti-cancer activity. In some embodiments, the ADC constructs disclosed herein exhibit in vivo treatment efficacy when administered as a single dose.

The ADCs of the present disclosure may selectively deliver an effective dose of a cytotoxic or cytostatic agent to cancer cells. In some embodiments, a disclosed ADC has potent cytotoxic and/or cytostatic activity against cells expressing a target antigen (e.g., BCMA). In some embodiments, the cytotoxic and/or cytostatic activity of the ADC is dependent on target antigen expression in a cell. In some embodiments, the disclosed ADCs are particularly effective at killing cancer cells expressing a high level of target antigen, as compared to cancer cells expressing the same antigen at a low level. In some embodiments, the disclosed ADCs are particularly effective at killing cancer cells expressing the target antigen at a moderate level, as compared to cancer cells expressing the same antigen at a low level. Exemplary high BCMA-expressing cancer cells include but are not limited to human myeloma NCI-H929 cells. Exemplary moderate BCMA-expressing cancer cells include but are not limited to human myeloma OPM2 cells and human myeloma MOLP8 cells. In some embodiments, the disclosed ADCs are particularly effective at killing cancer cells expressing a target antigen while minimizing off-target killing. In some embodiments, the disclosed ADCs do not exhibit a cytotoxic and/or cytostatic effect on cancer cells that do not express a target antigen.

In some embodiments, cleavage of an ADC releases the splicing modulator from the antibody or antigen-binding fragment and linker. In some embodiments, the linker and/or splicing modulator is designed to facilitate bystander killing (the killing of neighboring cells). In some embodiments, the linker and/or splicing modulator is designed to facilitate bystander killing through cleavage after cellular internalization and diffusion of the linker-splicing modulator moiety and/or the splicing modulator moiety alone to neighboring cells. In some embodiments, the linker promotes cellular internalization. In some embodiments, the linker is designed to minimize cleavage in the extracellular environment and thereby reduce toxicity to off-target cells or tissue (e.g., non-cancerous cells or tissue), while preserving ADC binding to target cells or tissue and/or bystander killing of cancerous tissue that does not express an antigen targeted by the antibody or antigen-binding fragment of an ADC, but surrounds target cancer tissue expressing that antigen. In some embodiments, the drug moiety, or the catabolite of the drug moiety produced by cleavage of an ADC, is designed to facilitate uptake by target cells or by neighboring cells (i.e., cell permeable). Such splicing modulator moieties and catabolites may be referred to as "bystander active," whereas drug moieties or catabolites with reduced cell permeability may be referred to as "bystander inactive."

In some embodiments, the disclosed ADCs also demonstrate bystander killing activity. Without being bound by theory, the bystander killing activity of an ADC may be particularly beneficial where its penetration into a solid tumor is limited and/or target antigen expression among tumor cells is heterogeneous. In some embodiments, the ADCs disclosed herein exhibit improved solubility and target cell penetrance over the drug moieties on their own. In some embodiments, the ADCs disclosed herein exhibit improved cytotoxicity over that of the drug moiety on its own. In some embodiments, ADCs disclosed herein use drug moieties that exhibit lower cytotoxicity, when evaluated as a stand-alone drug, yet are surprisingly better than ADCs comprising other drug moieties which have higher cytotoxicity when evaluated as a stand-alone drug. In some embodiments, cleavage and release of the splicing modulator improves cytotoxicity of the ADC, relative to comparable treatment with an ADC comprising a non-cleavable linker. In other embodiments, cleavage and release of the splicing modulator is not required for an ADC to possess a desirable biological activity.

Provided herein are ADCs comprising an antibody or antigen-binding fragment thereof (Ab) that is capable of binding to BCMA, a splicing modulator drug moiety (D), and a linker moiety (L) that covalently attaches Ab to D. In some embodiments, the antibody or antigen-binding fragment can bind to BCMA with high specificity and high affinity. In some embodiments, the antibody or antigen-binding fragment is internalized into a target cell upon binding, e.g., into a degradative compartment in the cell. In some embodiments, ADCs that internalize upon binding to a target cell, undergo degradation, and release the splicing modulator drug moiety to kill cancer cells may be used. The splicing modulator drug moiety may be released from the antibody and/or the linker moiety of the ADC by enzymatic action, hydrolysis, oxidation, or any other mechanism.

An exemplary ADC has Formula (I):

Ab-(L-D)$_p$         (I)

wherein Ab=an antibody or antigen-binding fragment, L=a linker moiety, D=a splicing modulator drug moiety, and p=the number of splicing modulator drug moieties per antibody or antigen-binding fragment.

In some embodiments, the antibody or antigen-binding fragment (Ab) for use in the described ADCs and compositions is an anti-BCMA antibody or antigen-binding fragment disclosed herein.

Linkers

In some embodiments, the linker in an ADC disclosed herein is stable extracellularly in a sufficient manner to be therapeutically effective. In some embodiments, the linker is stable outside a cell, such that the ADC remains intact when present in extracellular conditions (e.g., prior to transport or delivery into a cell). The term "intact," used in the context of an ADC, means that the antibody or antigen-binding fragment remains attached to the drug moiety (e.g., the splicing modulator). As used herein, "stable," in the context of a linker or ADC comprising a linker, means that no more than 20%, no more than about 15%, no more than about 10%, no more than about 5%, no more than about 3%, or no more than about 1% of the linkers (or any percentage in between) in a sample of ADC are cleaved (or in the case of an overall ADC are otherwise not intact) when the ADC is present in extracellular conditions. In some embodiments, the linkers and/or ADCs disclosed herein are surprisingly stable compared to alternate linkers and/or ADCs with alternate linkers and/or splicing modulator payloads. In some embodiments, the ADCs disclosed herein can remain intact for more than about 48 hours, more than 60 hours, more than about 72 hours, more than about 84 hours, or more than about 96 hours.

Whether a linker is stable extracellularly can be determined, for example, by including an ADC in plasma for a predetermined time period (e.g., 2, 4, 6, 8, 16, 24, 48, or 72 hours) and then quantifying the amount of free drug moiety present in the plasma. Stability may allow the ADC time to localize to target cancer cells and prevent the premature release of the drug moiety, which could lower the therapeutic index of the ADC by indiscriminately damaging both normal and cancer cells. In some embodiments, the linker is stable outside of a target cell and releases the drug moiety from the ADC once inside of the cell, such that the drug can bind to its target (e.g., to the SF3b spliceosome complex). Thus, in some embodiments, an effective linker will: (i) maintain the specific binding properties of the antibody or antigen-binding fragment; (ii) allow delivery, e.g., intracellular delivery, of the drug moiety via stable attachment to the antibody or antigen-binding fragment; (iii) remain stable and intact until the ADC has been transported or delivered to its target site; and (iv) allow for the therapeutic effect, e.g., cytotoxic effect, of the drug moiety after cleavage or alternate release mechanism.

Linkers may impact the physico-chemical properties of an ADC. As many cytotoxic agents are hydrophobic in nature, linking them to the antibody with an additional hydrophobic moiety may lead to aggregation. ADC aggregates are insoluble and often limit achievable drug loading onto the antibody, which can negatively affect the potency of the ADC. Protein aggregates of biologics, in general, have also been linked to increased immunogenicity. As shown below, linkers disclosed herein result in ADCs with low aggregation levels and desirable levels of drug loading.

Linkers described in Intl. App. No. PCT/US2019/035015 (Pub. No. WO 2019/232449) may be used with the ADCs disclosed herein. Intl. App. No. PCT/US2019/035015 (Pub. No. WO 2019/232449) is incorporated herein by reference for all exemplary linkers and linker attachment points to antibodies.

A linker may be "cleavable" or "non-cleavable" (Ducry and Stump (2010) Bioconjugate Chem. 21:5-13). Cleavable linkers are designed to release the drug moiety (e.g., the splicing modulator) when subjected to certain environment factors, e.g., when internalized into the target cell, whereas non-cleavable linkers generally rely on the degradation of the antibody or antigen-binding fragment itself.

In some embodiments, the linker is a non-cleavable linker. In some embodiments, the splicing modulator drug moiety of the ADC is released by degradation of the antibody or antigen-binding fragment. Non-cleavable linkers tend to remain covalently associated with at least one amino acid of the antibody and the drug upon internalization by and degradation within the target cell. Numerous exemplary non-cleavable linkers are described herein, and others are known in the art. Exemplary non-cleavable linkers may comprise thioether, cyclohexyl, N-succinimidyl 4-(N-maleimidomethyl) cyclohexane-1 carboxylate (SMCC), or N-hydroxysuccinimide (NHS), one or more polyethylene glycol (PEG) moieties (e.g., 1, 2, 3, 4, 5, or 6 PEG moieties), or one or more alkyl moieties (e.g., 1, 2, 3, 4, 5, or 6 alkyl moieties).

In some other embodiments, the linker is a cleavable linker. A cleavable linker refers to any linker that comprises a cleavable moiety. As used herein, the term "cleavable moiety" refers to any chemical bond that can be cleaved. Suitable cleavable chemical bonds are well known in the art and include, but are not limited to, acid labile bonds, protease/peptidase labile bonds, photolabile bonds, disulfide bonds, and esterase labile bonds. Linkers comprising a cleavable moiety can allow for the release of the splicing modulator drug moiety from the ADC via cleavage at a particular site in the linker.

In some embodiments, the linker is cleavable under intracellular conditions, such that cleavage of the linker sufficiently releases the splicing modulator drug moiety from the antibody or antigen-binding fragment in the intracellular environment to activate the drug and/or render the drug therapeutically effective. In some embodiments, the splicing modulator drug moiety is not cleaved from the antibody or antigen-binding fragment until the ADC enters a cell that expresses an antigen specific for the antibody or antigen-binding fragment of the ADC, and the splicing modulator drug moiety is cleaved from the antibody or antigen-binding fragment upon entering the cell. In some embodiments, the linker comprises a cleavable moiety that is positioned such that no part of the linker or the antibody or antigen-binding fragment remains bound to the splicing modulator drug moiety upon cleavage. Exemplary cleavable linkers include acid labile linkers, protease/peptidase-sensitive linkers, photolabile linkers, dimethyl-, disulfide-, or sulfonamide-containing linkers.

In some embodiments, the linker is a pH-sensitive linker, and is sensitive to hydrolysis at certain pH values. Typically, the pH-sensitive linker is cleavable under acidic conditions. This cleavage strategy generally takes advantage of the lower pH in the endosomal (pH~5-6) and lysosomal (pH~4.8) intracellular compartments, as compared to the cytosol (pH~7.4), to trigger hydrolysis of an acid labile group in the linker, such as a hydrazone (Jain et al. (2015) Pharm Res 32:3526-40). In some embodiments, the linker is an acid labile and/or hydrolyzable linker. For example, an acid labile linker that is hydrolyzable in the lysosome, and contains an acid labile group (e.g., a hydrazone, a semicarbazone, a thiosemicarbazone, a cis-aconitic amide, an orthoester, an acetal, a ketal, or the like) can be used. See, e.g., U.S. Pat. Nos. 5,122,368; 5,824,805; 5,622,929; Dubowchik and Walker (1999) Pharm Therapeutics 83:67-123; Neville et al. (1989) Biol Chem. 264:14653-61. Such linkers are relatively stable under neutral pH conditions, such as those in the blood, but are unstable at below pH 5.5 or 5.0, the approximate pH of the lysosome. In some embodiments, the hydrolyzable linker is a thioether linker (such as, e.g., a thioether attached to the therapeutic agent via an acylhydrazone bond) (see, e.g., U.S. Pat. No. 5,622,929).

In some embodiments, the linker is cleavable under reducing conditions. In some embodiments, the linker is cleavable in the presence of a reducing agent, such as glutathione or dithiothreitol. In some embodiments, the linker is a cleavable disulfide linker or a cleavable sulfonamide linker.

In some embodiments, the linker is a cleavable disulfide linker. A variety of disulfide linkers are known in the art, including, for example, those that can be formed using SATA (N-succinimidyl-5-acetylthioacetate), SPDP (N-succinimidyl-3-(2-pyridyldithio)propionate), SPDB (N-succinimidyl-3-(2-pyridyldithio)butyrate) and SMPT (N-succinimidyloxycarbonyl-alpha-methyl-alpha-(2-pyridyl-dithio) toluene), SPDB and SMPT. See, e.g., Thorpe et al. (1987) Cancer Res. 47:5924-31; Wawrzynczak et al., In Immunoconjugates: Antibody Conjugates in Radioimagery and Therapy of Cancer (C. W. Vogel ed., Oxford U. Press, 1987). See also U.S. Pat. No. 4,880,935. Disulfide linkers are typically used to exploit the abundance of intracellular thiols, which can facilitate the cleavage of their disulfide bonds. The intracellular concentrations of the most abundance intracellular thiol, reduced glutathione, are generally in the range of 1-10 nM, which is about 1,000-fold higher than that of the most abundant low-molecular thiol in the blood (i.e., cysteine) at about 5 µM (Goldmacher et al., In Cancer Drug Discovery and Development: Antibody-Drug Conjugates and Immunotoxins (G. L. Phillips ed., Springer, 2013)). The intracellular enzymes of the protein disulfide isomerase family may also contribute to the intracellular cleavage of a disulfide linker. As used herein, a cleavable disulfide linker refers to any linker that comprises a cleavable disulfide moiety. The term "cleavable disulfide moiety" refers to a disulfide bond that can be cleaved and/or reduced, e.g., by a thiol or enzyme.

In some embodiments, the linker is a cleavable sulfonamide linker. As used herein, a cleavable sulfonamide linker refers to any linker that comprises a cleavable sulfonamide moiety. The term "cleavable sulfonamide moiety" refers to a sulfonamide group, i.e., sulfonyl group connected to an amine group, wherein the sulfur-nitrogen bond can be cleaved.

In some embodiments, the linker may be a dendritic type linker for covalent attachment of more than one drug moiety to an antibody or antigen-binding fragment through a branching, multifunctional linker moiety. See, e.g., Sun et al. (2002) Bioorg Med Chem Lett. 12:2213-5; Sun et al. (2003) Bioorg Med Chem. 11:1761-8. Dendritic linkers can increase the molar ratio of drug to antibody, i.e., drug loading, which is related to the potency of the ADC. Thus, where an antibody or antigen-binding fragment bears only one reactive cysteine thiol group, for example, a multitude of splicing modulator drug moieties may be attached through a dendritic linker. In some embodiments, the linker moiety or linker-drug moiety may be attached to the antibody or antigen-binding fragment via reduced disulfide bridging chemistry or limited lysine utilization technology. See, e.g., Intl. Publ. Nos. WO 2013/173391 and WO 2013/173393.

In some embodiments, the linker is cleavable by a cleaving agent, e.g., an enzyme, that is present in the intracellular environment (e.g., within a lysosome or endosome or caveola). The linker can be, e.g., a peptide linker that is cleaved by an intracellular peptidase or protease enzyme, including, but not limited to, a lysosomal or endosomal protease. In some embodiments, the linker comprises a cleavable peptide moiety. In some embodiments, the linker comprises a cleavable glucuronide moiety.

In some embodiments, the linker is a cleavable peptide linker. As used herein, a cleavable peptide linker refers to any linker that comprises a cleavable peptide moiety. The term "cleavable peptide moiety" refers to any chemical bond linking amino acids (natural or synthetic amino acid derivatives) that can be cleaved by an agent that is present in the intracellular environment. In some embodiments, the cleavable peptide moiety is cleavable by an enzyme. For instance, a linker may comprise a valine-alanine (Val-Ala) sequence, or a valine-citrulline (Val-Cit) sequence that is cleavable by a peptidase such as cathepsin, e.g., cathepsin B. In some embodiments, a linker may comprise an alanine-alanine-aspartic acid (Ala-Ala-Asp) sequence. In some embodiments, a linker may comprise a glutamic acid-valine-citrulline (Glu-Val-Cit) sequence. In some embodiments, the linker is an enzyme-cleavable linker and a cleavable peptide moiety in the linker is cleavable by the enzyme. In some embodiments, the cleavable peptide moiety is cleavable by a lysosomal enzyme, e.g., cathepsin. In some embodiments, the linker is a cathepsin-cleavable linker. In some embodiments, the cleavable peptide moiety in the linker is cleavable by a lysosomal cysteine cathepsin, such as cathepsin B, C, F, H, K, L, O, S, V, X, or W. In some embodiments, the cleavable peptide moiety is cleavable by cathepsin B. An exemplary dipeptide that may be cleaved by cathepsin B is valine-citrulline (Val-Cit) (Dubowchik et al. (2002) Bioconjugate Chem. 13:855-69).

In some embodiments, the linker or the cleavable peptide moiety in the linker comprises an amino acid unit. In some embodiments, the amino acid unit allows for cleavage of the linker by a protease, thereby facilitating release of the splicing modulator drug moiety from the ADC upon exposure to one or more intracellular proteases, such as one or more lysosomal enzymes (Doronina et al. (2003) Nat Biotechnol. 21:778-84; Dubowchik and Walker (1999) Pharm Therapeutics 83:67-123). Exemplary amino acid units include, but are not limited to, dipeptides, tripeptides, tetrapeptides, and pentapeptides. Exemplary dipeptides include, but are not limited to, valine-alanine (Val-Ala), valine-citrulline (Val-Cit), alanine-asparagine (Ala-Asn), alanine-phenylalanine (Ala-Phe), phenylalanine-lysine (Phe-Lys), alanine-lysine (Ala-Lys), alanine-valine (Ala-Val), valine-lysine (Val-Lys), lysine-lysine (Lys-Lys), phenylalanine-citrulline (Phe-Cit), leucine-citrulline (Leu-Cit), isoleucine-citrulline (Ile-Cit), tryptophan-citrulline (Trp-Cit), and phenylalanine-alanine (Phe-Ala). Exemplary tripeptides include, but are not limited to, alanine-alanine-asparagine (Ala-Ala-Asn), glycine-valine-citrulline (Gly-Val-Cit), glycine-glycine-glycine (Gly-Gly-Gly), phenylalanine-phenylalanine-lysine (Phe-Phe-Lys), alanine-alanine-aspartic acid (Ala-Ala-Asp), glutamic acid-valine-citrulline (Glu-Val-Cit) (see Anami et al. (2018) Nat Comm. 9:2512), and glycine-phenylalanine-lysine (Gly-Phe-Lys). Other exemplary amino acid units include, but are not limited to, Gly-Phe-Gly-Gly (SEQ ID NO: 125), Gly-Phe-Leu-Gly (SEQ ID NO: 126), Ala-Leu-Ala-Leu (SEQ ID NO: 127), Phe-N[9]-tosyl-Arg, and Phe-N[9]-Nitro-Arg, as described in, e.g., U.S. Pat. No. 6,214,345. In some embodiments, the amino acid unit in the linker comprises Val-Ala. In some embodiments, the amino acid unit in the linker comprises Val-Cit. In some embodiments, the amino acid unit in the linker comprises Ala-Ala-Asp. In some embodiments, the amino acid unit in the linker comprises Glu-Val-Cit. An amino acid unit may comprise amino acid residues that occur naturally and/or minor amino acids and/or non-naturally occurring amino acid analogs, such as citrulline. Amino acid units can be designed and optimized for enzymatic cleavage by a particular enzyme, for example, a tumor-associated protease, a lysosomal protease such as cathepsin B, C, D, or S, or a plasmin protease.

In some embodiments, the linker is a cleavable glucuronide linker. As used herein, a cleavable glucuronide linker refers to any linker that comprises a cleavable glucuronide moiety. In some embodiments, the cleavable glucuronide moiety is cleavable by an enzyme. An exemplary cleavable glucuronide linker comprises the structure:

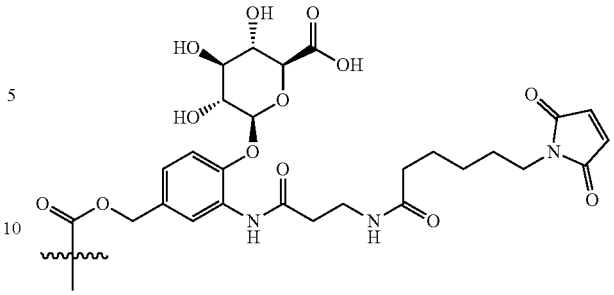

The term "cleavable glucuronide moiety" refers to a glycosidic bond that can be cleaved by an agent having glucuronidase activity. In some embodiments, the cleavable glucuronide moiety is cleavable by a glucuronidase. In some embodiments, the cleavable glucuronide moiety is cleavable by β-glucuronidase. In some embodiments, the cleavable glucuronide moiety or linker comprises a β-glucuronide, i.e., a glycosidic bond that can be cleaved by a β-glucuronidase. A β-glucuronidase is a UDP-glucuronosyl transferase that catalyzes the hydrolysis of the glycosidic bond of glucuronides with β-configuration.

In some embodiments, an ADC disclosed herein comprises a cleavable β-glucuronide moiety in the linker that is cleavable by an enzyme. In some embodiments, the cleavable β-glucuronide moiety in the linker is cleavable by a lysosomal enzyme, e.g., a β-glucuronidase. In some embodiments, the linker is a β-glucuronidase-cleavable linker. In some embodiments, the cleavable β-glucuronide moiety in the linker allows for cleavage of the linker by a β-glucuronidase after internalization of the ADC, thereby facilitating release of the drug moiety from the ADC in the cellular environment.

In some embodiments, the linker in an ADC disclosed herein comprises a maleimide moiety. The term "Mal" or "maleimide moiety," as used herein, means a compound that contains a maleimide group and that is reactive with a sulfhydryl group, e.g., a sulfhydryl group of a cysteine residue on the antibody or antigen-binding fragment. Other functional groups that are reactive with sulfhydryl groups (thiols) include, but are not limited to, iodoacetamide, bromoacetamide, vinyl pyridine, disulfide, pyridyl disulfide, isocyanate, and isothiocyanate. In some embodiments, the maleimide moiety comprises a maleimidocaproyl (MC). In some embodiments, the maleimide moiety is reactive with a cysteine residue on the antibody or antigen-binding fragment. In some embodiments, the maleimide moiety is attached to the antibody or antigen-binding fragment via a cysteine residue on the antibody or antigen-binding fragment.

In some embodiments, the linker comprises a maleimide moiety and a cleavable peptide moiety. In some embodiments, the cleavable peptide moiety comprises an amino acid unit. In some embodiments, the cleavable peptide moiety or amino acid unit comprises Val-Cit. In some embodiments, the cleavable peptide moiety or amino acid unit comprises Val-Ala. In some embodiments, the cleavable peptide moiety or amino acid unit comprises Ala-Ala-Asp. In some embodiments, the cleavable peptide moiety or amino acid unit comprises Glu-Val-Cit. In some embodiments, the linker comprises a maleimide moiety and a cleavable glucuronide moiety. In some embodiments, the cleavable glucuronide moiety comprises a β-glucuronide.

In some embodiments, the linker in an ADC disclosed herein may comprise at least one spacer unit joining the antibody or antigen-binding fragment to the drug moiety (e.g., the splicing modulator drug moiety). In some embodiments, a spacer unit between the antibody or antigen-binding fragment and cleavable moiety, when present, joins a cleavage site (e.g., a cleavable peptide moiety or a cleavable glucuronide moiety) in the linker to the antibody or antigen-binding fragment. In some embodiments, a spacer unit between the drug moiety and cleavable moiety, when present, joins a cleavage site (e.g., a cleavable peptide moiety or a cleavable glucuronide moiety) in the linker to the drug moiety. In some embodiments, no cleavage site is present, and the spacer unit is used to link the antibody or antigen-binding fragment to the drug moiety.

In some embodiments, the linker and/or spacer unit in the linker, is substantially hydrophilic. A hydrophilic linker may be used to reduce the extent to which the drug may be pumped out of resistant cancer cells through multiple drug resistance (MDR) or functionally similar transporters. In some embodiments, a hydrophilic linker may include one or more polyethylene glycol (PEG) moieties, e.g., 1, 2, 3, 4, 5, or 6 PEG moieties.

In some embodiments, a spacer unit in the linker comprises at least one PEG moiety. In some embodiments, the PEG moiety or spacer unit comprises one or more -(PEG)$_m$- and m is an integer from 1 to 10 (i.e., m may be 1, 2, 3, 4, 5, 6, 7, 8, 9, or 10). In some embodiments, m ranges from 1 to 10; from 2 to 8; from 2 to 6; from 2 to 5; from 2 to 4; or from 2 to 3. In some embodiments, m is 2. In some embodiments, the PEG moiety or spacer unit comprises (PEG)$_2$, (PEG)$_3$, (PEG)$_4$, (PEG)$_5$, (PEG)$_6$, (PEG)$_7$, (PEG)$_8$, (PEG)$_9$, or (PEG)$_{10}$. In some embodiments, the PEG moiety or spacer unit comprises (PEG)$_2$.

In some embodiments, a spacer unit in the linker comprises an alkyl moiety. In some embodiments, the alkyl moiety or spacer unit comprises one or more —(CH$_2$)$_n$— and n is an integer from 1 to 10 (i.e., n may be 1, 2, 3, 4, 5, 6, 7, 8, 9, or 10). In some embodiments, n ranges from 1 to 10; from 2 to 8; from 2 to 6; from 2 to 5; from 2 to 4; or from 2 to 3. In some embodiments, n is 2. In some embodiments, n is 5. In some embodiments, n is 6. In some embodiments, the spacer unit comprises (CH$_2$)$_2$, (CH$_2$)$_3$, (CH$_2$)$_4$, (CH$_2$)$_5$, (CH$_2$)$_6$, (CH$_2$)$_7$, (CH$_2$)$_8$, (CH$_2$)$_9$, or (CH$_2$)$_{10}$. In some embodiments, the alkyl moiety or spacer unit comprises (CH$_2$)$_2$ ("Et"). In some embodiments, the alkyl moiety or spacer unit comprises (CH$_2$)$_6$ ("Hex"). In some embodiments, the alkyl moiety or spacer unit comprises (CH$_2$)$_2$—O—(CH$_2$)$_2$ ("Et-O-Et").

A spacer unit may be used, for example, to link the antibody or antigen-binding fragment to the drug moiety, either directly or indirectly. In some embodiments, the spacer unit links the antibody or antigen-binding fragment to the splicing modulator drug moiety directly. In some embodiments, the antibody or antigen-binding fragment and the splicing modulator drug moiety are attached via a spacer unit comprising one or more PEG moieties (e.g., (PEG)$_2$), or one or more alkyl moieties (e.g., (CH$_2$)$_2$, (CH$_2$)$_6$, or (CH$_2$)$_2$—O—(CH$_2$)$_2$). In some embodiments, the spacer unit links the antibody or antigen-binding fragment to the splicing modulator drug moiety indirectly. In some embodiments, the spacer unit links the antibody or antigen-binding fragment to the splicing modulator drug moiety indirectly through a cleavable moiety (e.g., a cleavable peptide or a cleavable β-glucuronide) and/or an attachment moiety to join the spacer unit to the antibody or antigen-binding fragment, e.g., a maleimide moiety.

A spacer unit, in various embodiments, is attached to the antibody or antigen-binding fragment (i.e., the antibody or antigen-binding fragment) via a maleimide moiety. A spacer unit that attaches to the antibody or antigen-binding fragment via a maleimide moiety is referred to herein as a "Mal-spacer unit." In some embodiments, the Mal-spacer unit comprises a PEG moiety. In some embodiments, the Mal-spacer unit comprises an alkyl moiety. In some embodiments, the Mal-spacer unit comprises a maleimidocaproyl (MC).

In some embodiments, the linker comprises the structure: Mal-spacer unit. In some embodiments, the Mal-spacer unit or linker comprises MC. In some embodiments, the linker comprises the structure: MC. In some embodiments, the linker comprises the structure: Mal-(CH$_2$)$_2$ ("Mal-Et"). In some embodiments, the linker comprises the structure: Mal-(CH$_2$)$_6$ ("Mal-Hex"). In some embodiments, the linker comprises the structure: Mal-(CH$_2$)$_2$—O—(CH$_2$)$_2$ ("Mal-Et-O-Et"). In some embodiments, the linker comprises the structure: Mal-(PEG)$_2$. In some embodiments, the linker comprises the structure: Mal-(PEG)$_2$-CO.

In some embodiments, the linker comprises the Mal-spacer unit and a cleavable peptide moiety. In some embodiments, the cleavable peptide moiety comprises an amino acid unit. In some embodiments, the cleavable peptide moiety or amino acid unit comprises Val-Cit, Val-Ala, Ala-Ala-Asp, or Glu-Val-Cit. In some embodiments, the cleavable peptide moiety or amino acid unit comprises Val-Cit. In some embodiments, the cleavable peptide moiety or amino acid unit comprises Val-Ala. In some embodiments, the cleavable peptide moiety or amino acid unit comprises Ala-Ala-Asp. In some embodiments, the cleavable peptide moiety or amino acid unit comprises Glu-Val-Cit. In some embodiments, the linker comprises the Mal-spacer unit and a cleavable glucuronide moiety. In some embodiments, the cleavable glucuronide moiety comprises a β-glucuronide.

In some embodiments, the maleimide moiety or Mal-spacer unit attaches the antibody or antigen-binding fragment to the cleavable moiety in the linker. In some embodiments, the cleavable moiety in the linker comprises a cleavable peptide moiety. In some embodiments, the cleavable peptide moiety comprises an amino acid unit. In some embodiments, the cleavable peptide moiety or amino acid unit comprises Val-Cit, Val-Ala, Ala-Ala-Asp, or Glu-Val-Cit. In some embodiments, the cleavable moiety in the linker comprises a cleavable glucuronide moiety. In some embodiments, the cleavable glucuronide moiety comprises a β-glucuronide.

In some embodiments, the Mal-spacer unit attaches the antibody or antigen-binding fragment to a cleavable peptide moiety. In some embodiments, the linker comprises Mal-spacer unit-peptide.

In some embodiments, the linker comprises the structure: Mal-spacer unit-Val-Cit. In some embodiments, the Mal-spacer unit comprises MC. In some embodiments, the linker comprises MC-Val-Cit. In some embodiments, the linker comprises MC-(PEG)$_2$-Val-Cit.

In some embodiments, the linker comprises the structure: Mal-spacer unit-Val-Ala. In some embodiments, the Mal-spacer unit comprises MC. In some embodiments, the linker comprises MC-Val-Ala.

In some embodiments, the linker comprises the structure: Mal-spacer unit-Ala-Ala-Asp. In some embodiments, the Mal-spacer unit comprises MC. In some embodiments, the linker comprises MC-Ala-Ala-Asp.

In some embodiments, the linker comprises the structure: Mal-spacer unit-Glu-Val-Cit. In some embodiments, the Mal-spacer unit comprises MC. In some embodiments, the linker comprises MC-Glu-Val-Cit.

In some embodiments, the Mal-spacer unit attaches the antibody or antigen-binding fragment to a cleavable glucuronide moiety. In some embodiments, the linker comprises the structure: Mal-spacer unit-β-glucuronide. In some embodiments, the Mal-spacer unit comprises MC. In some embodiments, the linker comprises MC-β-glucuronide.

In some embodiments, the cleavable moiety in the linker is directly attached to the splicing modulator drug moiety. In other embodiments, a spacer unit attaches the cleavable moiety in the linker to the splicing modulator drug moiety. In some embodiments, the splicing modulator is attached to the cleavable moiety in the linker by a spacer unit.

A spacer unit may be "self-immolative" or "non-self-immolative." A "non-self-immolative" spacer unit is one in which part or all of the spacer unit remains bound to the splicing modulator drug moiety upon cleavage of the linker. Examples of non-self-immolative spacer units include, but are not limited to, a glycine spacer unit and a glycine-glycine spacer unit. Non-self-immolative spacer units may eventually degrade over time but do not readily release a linked native drug moiety entirely under cellular conditions. A "self-immolative" spacer unit allows for release of the native drug moiety under intracellular conditions. A "native drug" or "native drug moiety" is one where no part of the spacer unit or other chemical modification remains after cleavage/degradation of the spacer unit.

Self-immolation chemistry is known in the art and could be readily selected for the disclosed ADCs. In some embodiments, the spacer unit attaching the cleavable moiety in the linker to the splicing modulator drug moiety is self-immolative and undergoes self-immolation concurrently with or shortly before/after cleavage of the cleavable moiety under intracellular conditions. In some embodiments, cleavage of the conjugate releases the splicing modulator from the antibody or antigen-binding fragment and linker.

In some embodiments, the spacer unit attaching the cleavable moiety in the linker to the splicing modulator is self-immolative. In certain embodiments, the splicing modulator is attached to the cleavable moiety in the linker by a self-immolative spacer unit, the cleavable moiety comprises Val-Cit, and MC joins the cleavable moiety to the antibody or antigen-binding fragment. In certain embodiments, the splicing modulator is attached to the cleavable moiety in the linker by a self-immolative spacer unit, the cleavable moiety comprises Val-Cit, and MC-(PEG)₂ joins the cleavable moiety to the antibody or antigen-binding fragment. In certain embodiments, the splicing modulator is attached to the cleavable moiety in the linker by a self-immolative spacer unit, the cleavable moiety comprises Val-Ala, and MC joins the cleavable moiety to the antibody or antigen-binding fragment. In certain embodiments, the splicing modulator is attached to the cleavable moiety in the linker by a self-immolative spacer unit, the cleavable moiety comprises Ala-Ala-Asp, and MC joins the cleavable moiety to the antibody or antigen-binding fragment. In certain embodiments, the splicing modulator is attached to the cleavable moiety in the linker by a self-immolative spacer unit, the cleavable moiety comprises Glu-Val-Cit, and MC joins the cleavable moiety to the antibody or antigen-binding fragment. In certain embodiments, the splicing modulator is attached to the cleavable moiety in the linker by a self-immolative spacer unit, the cleavable moiety comprises a β-glucuronide, and MC joins the cleavable moiety to the antibody or antigen-binding fragment.

In some embodiments, the spacer unit attaching the cleavable moiety in the linker to the splicing modulator (e.g., a self-immolative spacer unit) comprises a p-aminobenzyl unit. In some embodiments, a p-aminobenzyl alcohol (pABOH) is attached to an amino acid unit or other cleavable moiety in the linker via an amide bond, and a carbamate, methylcarbamate, or carbonate is made between the pABOH and the drug moiety (Hamann et al. (2005) Expert Opin Ther Patents. 15:1087-103).

In some embodiments, the spacer unit attaching the cleavable moiety in the linker to the splicing modulator (e.g., a self-immolative spacer unit) is or comprises a p-aminobenzyloxycarbonyl (pABC). Without being bound by theory, it is thought that the self-immolation of pABC involves a spontaneous 1,6-elimination reaction (Jain et al. (2015) Pharm Res. 32:3526-40). In some embodiments, the spacer unit attaching the cleavable moiety in the linker to the splicing modulator (e.g., a self-immolative spacer unit) is or comprises a p-aminobenzyl (pAB). In some embodiments, the self-immolation of pAB involves a spontaneous 1,6-elimination reaction.

In various embodiments, a self-immolative spacer unit attaches the cleavable moiety in the linker to the splicing modulator. In some embodiments, the self-immolative spacer unit in the linker comprises a p-aminobenzyl unit.

In some embodiments, the self-immolative spacer unit in the linker consists of or comprises pABC. In some embodiments, the pABC attaches the cleavable moiety in the linker to the splicing modulator. In some embodiments, the pABC undergoes self-immolation upon cleavage of the cleavable moiety, and the splicing modulator is released from the ADC in its native, active form.

In some embodiments, the structure of the pABC used in the disclosed ADCs is shown below:

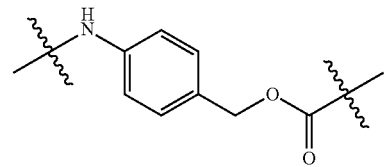 [SMILES: *Nc1ccc(COC(*)=O)cc1]

In some embodiments, the cleavable moiety in the linker comprises a cleavable peptide moiety. In some embodiments, the cleavable peptide moiety comprises an amino acid unit. In some embodiments, the linker comprises amino acid unit-pABC. In some embodiments, the cleavable peptide moiety or amino acid unit comprises Val-Cit, Val-Ala, Ala-Ala-Asp, or Glu-Val-Cit. In some embodiments, the linker comprises Val-Cit-pABC. In some embodiments, the linker comprises Val-Ala-pABC. In some embodiments, the linker comprises Ala-Ala-Asp-pABC. In some embodiments, the linker comprises Glu-Val-Cit-pABC. In some embodiments, the cleavable moiety in the linker comprises a cleavable glucuronide moiety. In some embodiments, the cleavable glucuronide moiety comprises a β-glucuronide. In some embodiments, the linker comprises β-glucuronide-pABC.

In some embodiments, the antibody or antigen-binding fragment of the ADC is conjugated to the splicing modulator drug moiety via a linker, wherein the linker comprises a Mal-spacer unit (e.g., MC, MC-(PEG)₂), a cleavable amino acid unit, and a pABC. In some embodiments, the spacer unit comprises a PEG moiety. In some embodiments, the Mal-spacer unit comprises MC. In some embodiments, the cleavable linker comprises Mal-spacer unit-amino acid unit-pABC. In some embodiments, the cleavable linker comprises MC-amino acid unit-pABC. In some embodiments, the cleavable linker comprises MC-Val-Cit-pABC, MC-Val-Ala-pABC, MC-Ala-Ala-Asp-pABC, MC-Glu-Val-Cit-pABC, or MC-(PEG)$_2$-Val-Cit-pABC. In some embodiments, the cleavable linker comprises MC-Val-Cit-pABC. In some embodiments, the cleavable linker comprises MC-Val-Ala-pABC. In some embodiments, the cleavable linker comprises MC-Ala-Ala-Asp-pABC. In some embodiments, the cleavable linker comprises MC-Glu-Val-Cit-pABC. In some embodiments, the cleavable linker comprises MC-(PEG)$_2$-Val-Cit-pABC.

In some embodiments, the antibody or antigen-binding fragment of the ADC is conjugated to the splicing modulator drug moiety via a linker, wherein the linker comprises a Mal-spacer unit (e.g., MC), a cleavable β-glucuronide, and a pABC. In some embodiments, the Mal-spacer unit comprises MC. In some embodiments, the cleavable linker comprises Mal-spacer unit-β-glucuronide-pABC. In some embodiments, the cleavable linker comprises MC-β-glucuronide-pABC.

In some embodiments, an anti-BCMA antibody or antigen-binding fragment is joined to the splicing modulator by a linker comprising MC-Val-Cit-pABC. In some embodiments, an anti-BCMA antibody or antigen-binding fragment is joined to the splicing modulator by a linker comprising MC-Val-Ala-pABC. In some embodiments, an anti-BCMA antibody or antigen-binding fragment is joined to the splicing modulator by a linker comprising MC-Ala-Ala-Asp-pABC. In some embodiments, an anti-BCMA antibody or antigen-binding fragment is joined to the splicing modulator by a linker comprising MC-Glu-Val-Cit-pABC. In some embodiments, an anti-BCMA antibody or antigen-binding fragment is joined to the splicing modulator by a linker comprising MC-(PEG)$_2$-Val-Cit-pABC. In some embodiments, an anti-BCMA antibody or antigen-binding fragment is joined to the splicing modulator by a linker comprising MC-β-glucuronide-pABC.

In some embodiments, the self-immolative spacer unit in the linker consists of or comprises a p-aminobenzyl (pAB). In some embodiments, the pAB attaches the cleavable moiety in the linker to the splicing modulator. In some embodiments, the pAB undergoes self-immolation upon cleavage of the cleavable moiety, and the splicing modulator is released from the ADC in its native, active form.

In some embodiments, the structure of the pAB used in the disclosed ADCs is shown below:

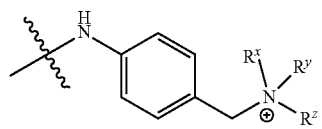

In some embodiments, the cleavable moiety in the linker comprises a cleavable peptide moiety. In some embodiments, the cleavable peptide moiety comprises an amino acid unit. In some embodiments, the linker comprises amino acid unit-pAB. In some embodiments, the cleavable peptide moiety or amino acid unit comprises Val-Cit, Val-Ala, Ala-Ala-Asp, or Glu-Val-Cit. In some embodiments, the linker comprises Val-Cit-pAB. In some embodiments, the linker comprises Val-Ala-pAB. In some embodiments, the linker comprises Ala-Ala-Asp-pAB. In some embodiments, the linker comprises Glu-Val-Cit-pAB. In some embodiments, the cleavable moiety in the linker comprises a cleavable glucuronide moiety. In some embodiments, the cleavable glucuronide moiety comprises a β-glucuronide. In some embodiments, the linker comprises β-glucuronide-pAB.

In some embodiments, the antibody or antigen-binding fragment of the ADC is conjugated to the splicing modulator drug moiety via a linker, wherein the linker comprises a Mal-spacer unit (e.g., MC, MC-(PEG)$_2$), a cleavable amino acid unit, and a pAB. In some embodiments, the spacer unit comprises a PEG moiety. In some embodiments, the Mal-spacer unit comprises MC. In some embodiments, the cleavable linker comprises Mal-spacer unit-amino acid unit-pAB. In some embodiments, the cleavable linker comprises MC-Val-Cit-pAB, MC-Val-Ala-pAB, MC-Ala-Ala-Asp-pAB, MC-Glu-Val-Cit-pAB, or MC-(PEG)$_2$-Val-Cit-pAB. In some embodiments, the cleavable linker comprises MC-Val-Cit-pAB. In some embodiments, the cleavable linker comprises MC-Val-Ala-pAB. In some embodiments, the cleavable linker comprises MC-Ala-Ala-Asp-pAB. In some embodiments, the cleavable linker comprises MC-Glu-Val-Cit-pAB. In some embodiments, the cleavable linker comprises MC-(PEG)$_2$-Val-Cit-pAB.

In some embodiments, the antibody or antigen-binding fragment of the ADC is conjugated to the splicing modulator drug moiety via a linker, wherein the linker comprises a Mal-spacer unit (e.g., MC), a cleavable β-glucuronide, and a pAB. In some embodiments, the Mal-spacer unit comprises MC. In some embodiments, the cleavable linker comprises Mal-spacer unit-β-glucuronide-pAB. In some embodiments, the cleavable linker comprises MC-β-glucuronide-pAB.

In some embodiments, an anti-BCMA antibody or antigen-binding fragment is joined to the splicing modulator by a linker comprising MC-Val-Cit-pAB. In some embodiments, an anti-BCMA antibody or antigen-binding fragment is joined to the splicing modulator by a linker comprising MC-Val-Ala-pAB. In some embodiments, an anti-BCMA antibody or antigen-binding fragment is joined to the splicing modulator by a linker comprising MC-Ala-Ala-Asp-pAB. In some embodiments, an anti-BCMA antibody or antigen-binding fragment is joined to the splicing modulator by a linker comprising MC-Glu-Val-Cit-pAB. In some embodiments, an anti-BCMA antibody or antigen-binding fragment is joined to the splicing modulator by a linker comprising MC-(PEG)$_2$-Val-Cit-pAB. In some embodiments, an anti-BCMA antibody or antigen-binding fragment is joined to the splicing modulator by a linker comprising MC-β-glucuronide-pAB.

In some embodiments, the splicing modulator is joined to the antibody or antigen-binding fragment via a Mal-spacer unit in the linker joined to a Val-Cit cleavable moiety and a pABC or pAB self-immolative spacer unit. In some other embodiments, the splicing modulator is joined to the antibody or antigen-binding fragment via a Mal-spacer unit in the linker joined to a Val-Ala cleavable moiety and a pABC or pAB self-immolative spacer unit. In some other embodiments, the splicing modulator is joined to the antibody or antigen-binding fragment via a Mal-spacer unit in the linker joined to an Ala-Ala-Asp cleavable moiety and a pABC or pAB self-immolative spacer unit. In some other embodiments, the splicing modulator is joined to the antibody or antigen-binding fragment via a Mal-spacer unit in the linker joined to a Glu-Val-Cit cleavable moiety and a pABC or pAB self-immolative spacer unit. In some other embodiments, the splicing modulator is joined to the antibody or antigen-binding fragment via a Mal-spacer unit in the linker joined to a β-glucuronide cleavable moiety and a pABC or pAB self-immolative spacer unit. In some embodiments, the spacer unit comprises a PEG moiety. In some embodiments, the Mal-spacer unit comprises MC. In some embodiments, the Mal-spacer unit comprises MC and a PEG moiety. In some embodiments, the Mal-spacer unit comprises MC-(PEG)$_m$- and m is an integer from 1 to 10 (e.g., 1, 2, 3, 4, 5, 6, 7, 8, 9, or 10). In some embodiments, the Mal-spacer unit comprises MC-(PEG)$_2$.

In some other embodiments, the splicing modulator is joined to the antibody or antigen-binding fragment via a Mal-spacer unit in the linker joined to a Val-Cit cleavable moiety and a non-self-immolative spacer unit. In some other embodiments, the splicing modulator is joined to the antibody or antigen-binding fragment via a Mal-spacer unit in the linker joined to a Val-Ala cleavable moiety and a non-self-immolative spacer unit. In some other embodiments, the splicing modulator is joined to the antibody or antigen-binding fragment via a Mal-spacer unit in the linker joined to an Ala-Ala-Asp cleavable moiety and a non-self-immolative spacer unit. In some other embodiments, the splicing modulator is joined to the antibody or antigen-binding fragment via a Mal-spacer unit in the linker joined to a Glu-Val-Cit cleavable moiety and a non-self-immolative spacer unit. In some other embodiments, the splicing modulator is joined to the antibody or antigen-binding fragment via a Mal-spacer unit in the linker joined to a β-glucuronide cleavable moiety and a non-self-immolative spacer unit. In some embodiments, the spacer unit comprises a PEG moiety. In some embodiments, the Mal-spacer unit comprises MC. In some embodiments, the Mal-spacer unit comprises MC and a PEG moiety. In some embodiments, the Mal-spacer unit comprises MC-(PEG)$_m$- and m is an integer from 1 to 10 (e.g., 1, 2, 3, 4, 5, 6, 7, 8, 9, or 10). In some embodiments, the Mal-spacer unit comprises MC-(PEG)$_2$.

In some embodiments, an ADC of the present disclosure comprises Formula (I):

Ab-(L-D)$_p$      (I)

wherein

Ab is an antibody or antigen-binding fragment capable of binding to BCMA;

D is a splicing modulator;

L is a linker which covalently attaches Ab to D; and p is an integer from 1 to 15.

In some embodiments, the antibody or antigen-binding fragment (Ab) of the ADC is conjugated to the splicing modulator drug moiety via a linker, wherein the linker is any of the linkers disclosed or incorporated by reference herein, or comprises one or more components of any of the linkers disclosed or incorporated by reference herein.

In some embodiments, the linker is a non-cleavable linker. In some embodiments, the linker comprises at least one spacer unit joining the antibody or antigen-binding fragment to the drug moiety. In some embodiments, the spacer unit comprises at least one alkyl moiety. In some embodiments, the spacer unit comprises at least one PEG moiety.

In some embodiments, a spacer unit in the linker is attached to the antibody or antigen-binding fragment via a maleimide moiety ("Mal-spacer unit"). In some embodiments, the Mal-spacer unit comprises at least one alkyl moiety. In some embodiments, the Mal-spacer unit comprises at least one PEG moiety. In some embodiments, the Mal-spacer unit comprises MC. In some embodiments, the Mal-spacer unit attaches the antibody or antigen-binding fragment to the drug moiety.

In some embodiments, the Mal-spacer unit or linker comprises Mal-(PEG)$_2$, Mal-(PEG)$_3$, Mal-(PEG)$_4$, Mal-(PEG)$_5$, Mal-(PEG)$_6$, Mal-(PEG)$_7$, or Mal-(PEG)$_8$. In some embodiments, the Mal-spacer unit or linker comprises Mal-(PEG)$_2$. In some embodiments, the Mal-spacer unit or linker comprises Mal-(PEG)$_2$-CO, Mal-(PEG)$_3$-CO, Mal-(PEG)$_4$-CO, Mal-(PEG)$_5$-CO, Mal-(PEG)$_6$-CO, Mal-(PEG)$_7$-CO, or Mal-(PEG)$_8$-CO. In some embodiments, the Mal-spacer unit or linker comprises Mal-(PEG)$_2$-CO. In some embodiments, the Mal-spacer unit or linker comprises MC. In some embodiments, the Mal-spacer unit or linker comprises Mal-(CH$_2$)$_6$ ("Mal-Hex"). In some embodiments, the Mal-spacer unit or linker comprises Mal-(CH$_2$)$_2$ ("Mal-Et"). In some embodiments, the Mal-spacer unit or linker comprises Mal-(CH$_2$)$_2$—O—(CH$_2$)$_2$ ("Mal-Et-O-Et").

In some embodiments, the Mal-spacer unit or linker comprises Mal-(PEG)$_2$-CO. In some embodiments, the Mal-spacer unit or linker comprises Mal-(PEG)$_2$-CO and at least one additional spacer unit. In some embodiments, the Mal-(PEG)$_2$-CO attaches the antibody or antigen-binding fragment to the drug moiety. In some embodiments, linker comprises or consists of Mal-(PEG)$_2$-CO. An example of a "Mal-(PEG)$_2$-CO" linker is also referred to herein as "ADL2" or an "ADL2" linker.

In some embodiments, the Mal-spacer unit or linker comprises MC. In some embodiments, the Mal-spacer unit or linker comprises MC and at least one additional spacer unit. In some embodiments, the MC attaches the antibody or antigen-binding fragment to the drug moiety. In some embodiments, the linker comprises or consists of MC. An example of an "MC" linker is also referred to herein as "ADL10" or an "ADL10" linker.

In some embodiments, the Mal-spacer unit or linker comprises Mal-(CH$_2$)$_6$ ("Mal-Hex"). In some embodiments, the Mal-spacer unit or linker comprises Mal-Hex and at least one additional spacer unit. In some embodiments, the Mal-Hex attaches the antibody or antigen-binding fragment to the drug moiety. In some embodiments, the linker comprises Mal-Hex. An example of a "Mal-Hex" linker is also referred to herein as "ADL12" or an "ADL12" linker.

In some embodiments, the Mal-spacer unit or linker comprises Mal-(CH$_2$)$_2$ ("Mal-Et"). In some embodiments, the Mal-spacer unit or linker comprises Mal-Et and at least one additional spacer unit. In some embodiments, the Mal-Et attaches the antibody or antigen-binding fragment to the drug moiety. In some embodiments, the linker comprises Mal-Et. An example of a "Mal-Et" linker is also referred to herein as "ADL14" or an "ADL14" linker.

In some embodiments, the Mal-spacer unit or linker comprises Mal-(CH$_2$)$_2$—O—(CH$_2$)$_2$ ("Mal-Et-O-Et"). In some embodiments, the Mal-spacer unit or linker comprises Mal-Et-O-Et and at least one additional spacer unit. In some embodiments, the Mal-Et-O-Et attaches the antibody or antigen-binding fragment to the drug moiety. In some embodiments, the linker comprises Mal-Et-O-Et. An example of a "Mal-Et-O-Et" linker is also referred to herein as "ADL15" or an "ADL15" linker.

In some other embodiments, the Mal-spacer unit attaches the antibody or antigen binding-fragment to the cleavable moiety in the linker. In some embodiments, the cleavable moiety in the linker is a cleavable peptide moiety, e.g., an amino acid unit. In some embodiments, the cleavable peptide moiety is an amino acid unit. In some embodiments, the cleavable peptide moiety or amino acid unit is Val-Cit, Val-Ala, Ala-Ala-Asp, or Glu-Val-Cit. In some embodiments, the cleavable moiety in the linker is a cleavable glucuronide moiety, e.g., a β-glucuronide. In some embodiments, the cleavable glucuronide moiety is a β-glucuronide. In some embodiments, the Mal-spacer unit comprises MC. In some embodiments, the Mal-spacer unit comprises MC and a PEG moiety. In some embodiments, the Mal-spacer unit comprises MC-(PEG)$_m$- and m is an integer from 1 to 10 (e.g., 1, 2, 3, 4, 5, 6, 7, 8, 9, or 10). In some embodiments, the Mal-spacer unit comprises MC-(PEG)$_2$.

In some embodiments, the linker comprises MC-Val-Cit. In some embodiments, the linker comprises MC-(PEG)$_2$-Val-Cit. In some embodiments, the linker comprises MC-Val-Ala. In some embodiments, the linker comprises MC-Ala-Ala-Asp. In some embodiments, the linker comprises MC-Glu-Val-Cit. In some embodiments, the linker comprises MC-β-glucuronide.

In some embodiments, a spacer unit attaching the cleavable moiety in the linker to the splicing modulator. In some embodiments, the spacer unit attaching the cleavable moiety to the splicing modulator is self-immolative.

In some embodiments, the spacer unit attaching the cleavable moiety in the linker to the splicing modulator comprises pABC. In some embodiments, the pABC attaches the cleavable moiety to the splicing modulator. In some embodiments, the cleavable moiety is a cleavable peptide moiety, e.g., an amino acid unit. In some embodiments, the cleavable peptide moiety is an amino acid unit. In some embodiments, the linker comprises amino acid unit-pABC. In some embodiments, the amino acid unit comprises Val-Cit, Val-Ala, Ala-Ala-Asp, or Glu-Val-Cit. In some embodiments, the linker comprises Val-Cit-pABC. In some embodiments, the linker comprises Val-Ala-pABC. In some embodiments, the linker comprises Ala-Ala-Asp-pABC. In some embodiments, the linker comprises Glu-Val-Cit-pABC. In some embodiments, the cleavable moiety is a cleavable glucuronide moiety, e.g., a β-glucuronide. In some embodiments, the cleavable glucuronide moiety is a β-glucuronide. In some embodiments, the linker comprises β-glucuronide-pABC.

In some embodiments, the linker comprises Val-Cit-pABC. In some embodiments, the linker comprises Val-Cit-pABC and a MC Mal-spacer unit joining the linker to the antibody or antigen-binding fragment. In some embodiments, the linker comprises MC-Val-Cit-pABC. In some embodiments, the linker comprises MC-Val-Cit-pABC and at least one additional spacer unit. An example of an MC-Val-Cit-pABC linker is also referred to herein as "ADL1" or an "ADL1" linker. The structure of ADL1 and other exemplary linkers is shown in Table 13.

In some embodiments, the linker comprises Val-Ala-pABC. In some embodiments, the linker comprises Val-Ala-pABC and a MC Mal-spacer unit joining the linker to the antibody or antigen-binding fragment. In some embodiments, the linker comprises MC-Val-Ala-pABC. In some embodiments, the linker comprises MC-Val-Ala-pABC and at least one additional spacer unit. An example of an MC-Val-Ala-pABC linker is also referred to herein as "ADL6" or an "ADL6" linker. The structure of ADL6 and other exemplary linkers is shown in Table 13.

In some embodiments, the linker comprises β-glucuronide-pABC. In some embodiments, the linker comprises β-glucuronide-pABC and a MC Mal-spacer unit joining the linker to the antibody or antigen-binding fragment. In some embodiments, the linker comprises MC-β-glucuronide-pABC. In some embodiments, the linker comprises MC-β-glucuronide-pABC and at least one additional spacer unit. An example of an MC-β-glucuronide-pABC is also referred to herein as "ADL13" or an "ADL13" linker. The structure of ADL13 and other exemplary linkers is shown in Table 13.

In some embodiments, the linker comprises Ala-Ala-Asp-pABC. In some embodiments, the linker comprises Ala-Ala-Asp-pABC and a MC Mal-spacer unit joining the linker to the antibody or antigen-binding fragment. In some embodiments, the linker comprises MC-Ala-Ala-Asp-pABC. In some embodiments, the linker comprises MC-Ala-Ala-Asp-pABC and at least one additional spacer unit. An example of an MC-Ala-Ala-Asp-pABC linker is also referred to herein as "ADL21" or an "ADL21" linker. The structure of ADL21 and other exemplary linkers is shown in Table 13.

In some embodiments, the linker comprises Val-Cit-pABC. In some embodiments, the linker comprises Val-Cit-pABC and a MC-(PEG)$_2$ Mal-spacer unit joining the linker to the antibody or antigen-binding fragment. In some embodiments, the linker comprises MC-(PEG)$_2$-Val-Cit-pABC. In some embodiments, the linker comprises MC-(PEG)$_2$-Val-Cit-pABC and at least one additional spacer unit. An example of an MC-(PEG)$_2$-Val-Cit-pABC linker is also referred to herein as "ADL22" or an "ADL22" linker. The structure of ADL22 and other exemplary linkers is shown in Table 13.

In some embodiments, the linker comprises Glu-Val-Cit-pABC. In some embodiments, the linker comprises Glu-Val-Cit-pABC and a MC Mal-spacer unit joining the linker to the antibody or antigen-binding fragment. In some embodiments, the linker comprises MC-Glu-Val-Cit-pABC. In some embodiments, the linker comprises MC-Glu-Val-Cit-pABC and at least one additional spacer unit. An example of an MC-Glu-Val-Cit-pABC linker is also referred to herein as "ADL23" or an "ADL23" linker. The structure of ADL23 and other exemplary linkers is shown in Table 13.

In some embodiments, the spacer unit attaching the cleavable moiety in the linker to the splicing modulator comprises pAB. In some embodiments, the pAB attaches the cleavable moiety to the splicing modulator. In some embodiments, the cleavable moiety is a cleavable peptide moiety, e.g., an amino acid unit. In some embodiments, the cleavable peptide moiety is an amino acid unit. In some embodiments, the linker comprises amino acid unit-pAB. In some embodiments, the amino acid unit comprises Val-Cit, Val-Ala, Ala-Ala-Asp, or Glu-Val-Cit. In some embodiments, the linker comprises Val-Cit-pAB. In some embodiments, the linker comprises Val-Ala-pAB. In some embodiments, the linker comprises Ala-Ala-Asp-pAB. In some embodiments, the linker comprises Glu-Val-Cit-pAB. In some embodiments, the cleavable moiety is a cleavable glucuronide moiety, e.g., a β-glucuronide. In some embodiments, the cleavable glucuronide moiety is a β-glucuronide. In some embodiments, the linker comprises β-glucuronide-pAB.

In some embodiments, the linker comprises Val-Ala-pAB. In some embodiments, the linker comprises Val-Ala-pAB and a MC Mal-spacer unit joining the linker to the antibody or antigen-binding fragment. In some embodiments, the linker comprises MC-Val-Ala-pAB. In some embodiments, the linker comprises MC-Val-Ala-pAB and at least one additional spacer unit. An example of an MC-Val-Ala-pAB linker is also referred to herein as "ADL5" or an "ADL5" linker.

In some embodiments, the linker comprises Val-Cit-pAB. In some embodiments, the linker comprises Val-Cit-pAB and a MC Mal-spacer unit joining the linker to the antibody or antigen-binding fragment. In some embodiments, the linker comprises MC-Val-Cit-pAB. In some embodiments, the linker comprises MC-Val-Cit-pAB and at least one additional spacer unit. An example of an MC-Val-Cit-pAB linker is also referred to herein as "ADL7" or an "ADL7" linker.

In some embodiments, the antibody or antigen-binding fragment is conjugated to the splicing modulator drug moiety via an ADL1, ADL2, ADL5, ADL6, ADL7, ADL10, ADL12, ADL13, ADL14, ADL15, ADL21, ADL22, or ADL23 linker. In some embodiments, the antibody or antigen-binding fragment is conjugated to the splicing modulator drug moiety via an ADL1, ADL6, ADL13, ADL21, ADL22, or ADL23 linker. It has been discovered, in various embodiments, that ADCs comprising an ADL1, ADL6, ADL13, ADL21, ADL22, or ADL23 linker (e.g., an ADL1 linker) and a splicing modulator drug moiety disclosed herein demonstrate desirable properties for a therapeutic ADC. In some embodiments, these properties include, but are not limited to, effective levels of drug loading, low aggregation levels, stability under storage conditions or when in circulation in the body (e.g., serum stability), retained affinity for target antigen-expressing cells comparable to unconjugated antibody, potent cytotoxicity against target antigen-expressing cells, low levels of off-target cell killing, and/or effective in vivo anti-cancer activity, all as compared to ADCs using other linker-payloads.

In some embodiments, the ADC comprises ADL1-splicing modulator and an antibody or antigen-binding fragment capable of binding to BCMA. In some embodiments, the ADC comprises ADL2-splicing modulator and an antibody or antigen-binding fragment capable of binding to BCMA. In some embodiments, the ADC comprises ADL5-splicing modulator and an antibody or antigen-binding fragment capable of binding to BCMA. In some embodiments, the ADC comprises ADL6-splicing modulator and an antibody or antigen-binding fragment capable of binding to BCMA. In some embodiments, the ADC comprises ADL7-splicing modulator and an antibody or antigen-binding fragment capable of binding to BCMA. In some embodiments, the ADC comprises ADL10-splicing modulator and an antibody or antigen-binding fragment capable of binding to BCMA. In some embodiments, the ADC comprises ADL12-splicing modulator and an antibody or antigen-binding fragment capable of binding to BCMA. In some embodiments, the ADC comprises ADL13-splicing modulator and an antibody or antigen-binding fragment capable of binding to BCMA. In some embodiments, the ADC comprises ADL14-splicing modulator and an antibody or antigen-binding fragment capable of binding to BCMA. In some embodiments, the ADC comprises ADL15-splicing modulator and an antibody or antigen-binding fragment capable of binding to BCMA. In some embodiments, the ADC comprises ADL21-splicing modulator and an antibody or antigen-binding fragment capable of binding to BCMA. In some embodiments, the ADC comprises ADL22-splicing modulator and an antibody or antigen-binding fragment capable of binding to BCMA. In some embodiments, the ADC comprises ADL23-splicing modulator and an antibody or antigen-binding fragment capable of binding to BCMA. In some embodiments, the ADC retains the ability to target and internalize in a BCMA-expressing cancer cell.

In some embodiments, the antibody or antigen-binding fragment of an ADC disclosed herein is an internalizing antibody or internalizing antigen-binding fragment. In some embodiments, the antibody or antigen-binding fragment is capable of binding to BCMA and comprises three HCDRs comprising amino acid sequences of SEQ ID NO: 1 (HCDR1), SEQ ID NO: 2 (HCDR2), and SEQ ID NO: 3 (HCDR3); and three LCDRs comprising amino acid sequences of SEQ ID NO: 4 (LCDR1), SEQ ID NO: 5 (LCDR2), and SEQ ID NO: 6 (LCDR3), as defined by the Kabat numbering system; or three HCDRs comprising amino acid sequences of SEQ ID NO: 37 (HCDR1), SEQ ID NO: 38 (HCDR2), and SEQ ID NO: 39 (HCDR3); and three LCDRs comprising amino acid sequences of SEQ ID NO: 40 (LCDR1), SEQ ID NO: 41 (LCDR2), and SEQ ID NO: 42 (LCDR3), as defined by the IMGT numbering system.

In some embodiments, the ADC has Formula (I):

$$Ab\text{-}(L\text{-}D)_p \qquad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 2 (HCDR2), and SEQ ID NO: 3 (HCDR3); and three LCDRs comprising amino acid sequences of SEQ ID NO: 4 (LCDR1), SEQ ID NO: 5 (LCDR2), and SEQ ID NO: 6 (LCDR3), as defined by the Kabat numbering system; or three HCDRs comprising amino acid sequences of SEQ ID NO: 37 (HCDR1), SEQ ID NO: 38 (HCDR2), and SEQ ID NO: 39 (HCDR3); and three LCDRs comprising amino acid sequences of SEQ ID NO: 40 (LCDR1), SEQ ID NO: 41 (LCDR2), and SEQ ID NO: 42 (LCDR3), as defined by the IMGT numbering system;

D is a splicing modulator;

L is a linker comprising ADL1, ADL6, ADL13, ADL21, ADL22, or ADL23; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 76, and a light chain variable region comprising an amino acid sequence of SEQ ID NO: 77. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region. In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 92, and a light chain comprising an amino acid sequence of SEQ ID NO: 93. In some embodiments, the heavy chain constant region or heavy chain further comprises a C-terminal lysine (K). In some embodiments, the antibody or antigen-binding fragment of the ADC is AB212. In some embodiments, p is an integer from 1 to 12, from 1 to 10, from 2 to 8, or from 4 to 8. In some embodiments, p is 4. In some embodiments, p is 8.

In some embodiments, the antibody or antigen-binding fragment of an ADC disclosed herein is an internalizing antibody or internalizing antigen-binding fragment. In some embodiments, the antibody or antigen-binding fragment is capable of binding to BCMA and comprises three HCDRs comprising amino acid sequences of SEQ ID NO: 1 (HCDR1), SEQ ID NO: 7 (HCDR2), and SEQ ID NO: 8 (HCDR3); and three LCDRs comprising amino acid sequences of SEQ ID NO: 9 (LCDR1), SEQ ID NO: 10 (LCDR2), and SEQ ID NO: 11 (LCDR3), as defined by the Kabat numbering system; or three HCDRs comprising amino acid sequences of SEQ ID NO: 43 (HCDR1), SEQ ID NO: 44 (HCDR2), and SEQ ID NO: 45 (HCDR3); and three LCDRs comprising amino acid sequences of SEQ ID NO: 40 (LCDR1), SEQ ID NO: 41 (LCDR2), and SEQ ID NO: 46 (LCDR3), as defined by the IMGT numbering system.

In some embodiments, the ADC has Formula (I):

$$Ab\text{-}(L\text{-}D)_p \qquad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 7 (HCDR2), and SEQ ID NO: 8 (HCDR3); and three LCDRs comprising amino acid sequences of SEQ ID NO: 9 (LCDR1), SEQ ID NO: 10 (LCDR2), and SEQ ID NO: 11 (LCDR3), as defined by the Kabat numbering system; or three HCDRs comprising amino acid sequences of SEQ ID NO: 43 (HCDR1), SEQ ID NO: 44 (HCDR2), and SEQ ID NO: 45 (HCDR3); and three LCDRs comprising amino acid sequences of SEQ ID NO: 40 (LCDR1), SEQ ID NO: 41 (LCDR2), and SEQ ID NO: 46 (LCDR3), as defined by the IMGT numbering system;

D is a splicing modulator;

L is a linker comprising ADL1, ADL6, ADL13, ADL21, ADL22, or ADL23; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 78, and a light chain variable region comprising an amino acid sequence of SEQ ID NO: 79. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region. In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 94, and a light chain comprising an amino acid sequence of SEQ ID NO: 95. In some embodiments, the heavy chain constant region or heavy chain further comprises a C-terminal lysine (K). In some embodiments, the antibody or antigen-binding fragment of the ADC is AB213. In some embodiments, p is an integer from 1 to 12, from 1 to 10, from 2 to 8, or from 4 to 8. In some embodiments, p is 4. In some embodiments, p is 8.

In some embodiments, the antibody or antigen-binding fragment of an ADC disclosed herein is an internalizing antibody or internalizing antigen-binding fragment. In some embodiments, the antibody or antigen-binding fragment is capable of binding to BCMA and comprises three HCDRs comprising amino acid sequences of SEQ ID NO: 1 (HCDR1), SEQ ID NO: 12 (HCDR2), and SEQ ID NO: 13 (HCDR3); and three LCDRs comprising amino acid sequences of SEQ ID NO: 14 (LCDR1), SEQ ID NO: 15 (LCDR2), and SEQ ID NO: 16 (LCDR3), as defined by the Kabat numbering system; or three HCDRs comprising amino acid sequences of SEQ ID NO: 47 (HCDR1), SEQ ID NO: 48 (HCDR2), and SEQ ID NO: 49 (HCDR3); and three LCDRs comprising amino acid sequences of SEQ ID NO: 40 (LCDR1), SEQ ID NO: 41 (LCDR2), and SEQ ID NO: 50 (LCDR3), as defined by the IMGT numbering system.

In some embodiments, the ADC has Formula (I):

$$Ab\text{-}(L\text{-}D)_p \qquad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 12 (HCDR2), and SEQ ID NO: 13 (HCDR3); and three LCDRs comprising amino acid sequences of SEQ ID NO: 14 (LCDR1), SEQ ID NO: 15 (LCDR2), and SEQ ID NO: 16 (LCDR3), as defined by the Kabat numbering system; or three HCDRs comprising amino acid sequences of SEQ ID NO: 47 (HCDR1), SEQ ID NO: 48 (HCDR2), and SEQ ID NO: 49 (HCDR3); and three LCDRs comprising amino acid sequences of SEQ ID NO: 40 (LCDR1), SEQ ID NO: 41 (LCDR2), and SEQ ID NO: 50 (LCDR3), as defined by the IMGT numbering system;

D is a splicing modulator;

L is a linker comprising ADL1, ADL6, ADL13, ADL21, ADL22, or ADL23; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 80, and a light chain variable region comprising an amino acid sequence of SEQ ID NO: 81. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region. In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 96, and a light chain comprising an amino acid sequence of SEQ ID NO: 97. In some embodiments, the heavy chain constant region or heavy chain further comprises a C-terminal lysine (K). In some embodiments, the antibody or antigen-binding fragment of the ADC is AB214. In some embodiments, p is an integer from 1 to 12, from 1 to 10, from 2 to 8, or from 4 to 8. In some embodiments, p is 4. In some embodiments, p is 8.

In some embodiments, the antibody or antigen-binding fragment of an ADC disclosed herein is an internalizing antibody or internalizing antigen-binding fragment. In some embodiments, the antibody or antigen-binding fragment is capable of binding to BCMA and comprises three HCDRs comprising amino acid sequences of SEQ ID NO: 1 (HCDR1), SEQ ID NO: 17 (HCDR2), and SEQ ID NO: 18 (HCDR3); and three LCDRs comprising amino acid sequences of SEQ ID NO: 19 (LCDR1), SEQ ID NO: 20 (LCDR2), and SEQ ID NO: 21 (LCDR3), as defined by the Kabat numbering system; or three HCDRs comprising amino acid sequences of SEQ ID NO: 51 (HCDR1), SEQ ID NO: 52 (HCDR2), and SEQ ID NO: 53 (HCDR3); and three LCDRs comprising amino acid sequences of SEQ ID NO: 40 (LCDR1), SEQ ID NO: 41 (LCDR2), and SEQ ID NO: 54 (LCDR3), as defined by the IMGT numbering system.

In some embodiments, the ADC has Formula (I):

$$Ab\text{-}(L\text{-}D)_p \qquad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 17 (HCDR2), and SEQ ID NO: 18 (HCDR3); and three LCDRs comprising amino acid sequences of SEQ ID NO: 19 (LCDR1), SEQ ID NO: 20 (LCDR2), and SEQ ID NO: 21 (LCDR3), as defined by the Kabat numbering system; or three HCDRs comprising amino acid sequences of SEQ ID NO: 51 (HCDR1), SEQ ID NO: 52 (HCDR2), and SEQ ID NO: 53 (HCDR3); and three LCDRs comprising amino acid sequences of SEQ ID NO: 40 (LCDR1), SEQ ID NO: 41 (LCDR2), and SEQ ID NO: 54 (LCDR3), as defined by the IMGT numbering system;

D is a splicing modulator;

L is a linker comprising ADL1, ADL6, ADL13, ADL21, ADL22, or ADL23; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 82, and a light chain variable region comprising an amino acid sequence of SEQ ID NO: 83. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region.

In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 98, and a light chain comprising an amino acid sequence of SEQ ID NO: 99. In some embodiments, the heavy chain constant region or heavy chain further comprises a C-terminal lysine (K). In some embodiments, the antibody or antigen-binding fragment of the ADC is AB215. In some embodiments, p is an integer from 1 to 12, from 1 to 10, from 2 to 8, or from 4 to 8. In some embodiments, p is 4. In some embodiments, p is 8.

In some embodiments, the antibody or antigen-binding fragment of an ADC disclosed herein is an internalizing antibody or internalizing antigen-binding fragment. In some embodiments, the antibody or antigen-binding fragment is capable of binding to BCMA and comprises three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system.

In some embodiments, the ADC has Formula (I):

$$Ab\text{-}(L\text{-}D)_p \qquad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system;

D is a splicing modulator;

L is a linker comprising ADL1, ADL6, ADL13, ADL21, ADL22, or ADL23; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 84, and a light chain variable region comprising an amino acid sequence of SEQ ID NO: 85. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region. In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 100, and a light chain comprising an amino acid sequence of SEQ ID NO: 101. In some embodiments, the heavy chain constant region or heavy chain further comprises a C-terminal lysine (K). In some embodiments, the antibody or antigen-binding fragment of the ADC is AB216. In some embodiments, p is an integer from 1 to 12, from 1 to 10, from 2 to 8, or from 4 to 8. In some embodiments, p is 4. In some embodiments, p is 8.

In some embodiments, the antibody or antigen-binding fragment of an ADC disclosed herein is an internalizing antibody or internalizing antigen-binding fragment. In some embodiments, the antibody or antigen-binding fragment is capable of binding to BCMA and comprises three HCDRs comprising amino acid sequences of SEQ ID NO: 1 (HCDR1), SEQ ID NO: 27 (HCDR2), and SEQ ID NO: 28 (HCDR3); and three LCDRs comprising amino acid sequences of SEQ ID NO: 29 (LCDR1), SEQ ID NO: 30 (LCDR2), and SEQ ID NO: 31 (LCDR3), as defined by the Kabat numbering system; or three HCDRs comprising amino acid sequences of SEQ ID NO: 59 (HCDR1), SEQ ID NO: 60 (HCDR2), and SEQ ID NO: 61 (HCDR3); and three LCDRs comprising amino acid sequences of SEQ ID NO: 40 (LCDR1), SEQ ID NO: 41 (LCDR2), and SEQ ID NO: 62 (LCDR3), as defined by the IMGT numbering system.

In some embodiments, the ADC has Formula (I):

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 27 (HCDR2), and SEQ ID NO: 28 (HCDR3); and three LCDRs comprising amino acid sequences of SEQ ID NO: 29 (LCDR1), SEQ ID NO: 30 (LCDR2), and SEQ ID NO: 31 (LCDR3), as defined by the Kabat numbering system; or three HCDRs comprising amino acid sequences of SEQ ID NO: 59 (HCDR1), SEQ ID NO: 60 (HCDR2), and SEQ ID NO: 61 (HCDR3); and three LCDRs comprising amino acid sequences of SEQ ID NO: 40 (LCDR1), SEQ ID NO: 41 (LCDR2), and SEQ ID NO: 62 (LCDR3), as defined by the IMGT numbering system;

D is a splicing modulator;

L is a linker comprising ADL1, ADL6, ADL13, ADL21, ADL22, or ADL23; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 86, and a light chain variable region comprising an amino acid sequence of SEQ ID NO: 87. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region. In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 102, and a light chain comprising an amino acid sequence of SEQ ID NO: 103. In some embodiments, the heavy chain constant region or heavy chain further comprises a C-terminal lysine (K). In some embodiments, the antibody or antigen-binding fragment of the ADC is AB217. In some embodiments, p is an integer from 1 to 12, from 1 to 10, from 2 to 8, or from 4 to 8. In some embodiments, p is 4. In some embodiments, p is 8.

In some embodiments, the antibody or antigen-binding fragment of an ADC disclosed herein is an internalizing antibody or internalizing antigen-binding fragment. In some embodiments, the antibody or antigen-binding fragment is capable of binding to BCMA and comprises three HCDRs comprising amino acid sequences of SEQ ID NO: 1 (HCDR1), SEQ ID NO: 32 (HCDR2), and SEQ ID NO: 33 (HCDR3); and three LCDRs comprising amino acid sequences of SEQ ID NO: 34 (LCDR1), SEQ ID NO: 35 (LCDR2), and SEQ ID NO: 36 (LCDR3), as defined by the Kabat numbering system; or three HCDRs comprising amino acid sequences of SEQ ID NO: 63 (HCDR1), SEQ ID NO: 64 (HCDR2), and SEQ ID NO: 65 (HCDR3); and three LCDRs comprising amino acid sequences of SEQ ID NO: 40 (LCDR1), SEQ ID NO: 41 (LCDR2), and SEQ ID NO: 66 (LCDR3), as defined by the IMGT numbering system.

In some embodiments, the ADC has Formula (I):

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 32 (HCDR2), and SEQ ID NO: 33 (HCDR3); and three LCDRs comprising amino acid sequences of SEQ ID NO: 34 (LCDR1), SEQ ID NO: 35 (LCDR2), and SEQ ID NO: 36 (LCDR3), as defined by the Kabat numbering system; or three HCDRs comprising amino acid sequences of SEQ ID NO: 63 (HCDR1), SEQ ID NO: 64 (HCDR2), and SEQ ID NO: 65 (HCDR3); and three LCDRs comprising amino acid sequences of SEQ ID NO: 40 (LCDR1), SEQ ID NO: 41 (LCDR2), and SEQ ID NO: 66 (LCDR3), as defined by the IMGT numbering system;

D is a splicing modulator;

L is a linker comprising ADL1, ADL6, ADL13, ADL21, ADL22, or ADL23; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 88, and a light chain variable region comprising an amino acid sequence of SEQ ID NO: 89. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region. In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 104, and a light chain comprising an amino acid sequence of SEQ ID NO: 105. In some embodiments, the heavy chain constant region or heavy chain further comprises a C-terminal lysine (K). In some embodiments, the antibody or antigen-binding fragment of the ADC is AB218. In some embodiments, p is an integer from 1 to 12, from 1 to 10, from 2 to 8, or from 4 to 8. In some embodiments, p is 4. In some embodiments, p is 8.

Drug Moieties

The drug moiety (D) of an ADC as described herein can be any chemotherapeutic agent. Useful classes of chemotherapeutic agents include, for example, modulators of RNA splicing. In some embodiments, the drug moiety is a splicing modulator. Exemplary splicing modulator compounds are described and exemplified herein.

In some embodiments, the drug moiety is a splicing modulator selected from those shown and described in Intl. App. No. PCT/US2019/035015 (Pub. No. WO 2019/232449), which is incorporated herein by reference for all its disclosed splicing modulator compounds and methods of synthesizing those compounds. In some embodiments, Intl. App. No. PCT/US2019/035015 (Pub. No. WO 2019/232449) also provides and is incorporated herein by reference for all exemplary linkers and linker attachment points for joining splicing modulators to antibodies. In some embodiments, the splicing modulator and the linker used in the ADCs disclosed herein are each selected from those shown and described in Intl. App. No. PCT/US2019/035015 (Pub. No. WO 2019/232449). In some embodiments, the splicing modulator is joined to an antibody moiety via a linker as disclosed in Intl. App. No. PCT/US2019/035015 (Pub. No. WO 2019/232449).

"Alkyl" or "alkyl group," as used herein, means a straight-chain, branched, or cyclic hydrocarbon chain that is completely saturated. In certain embodiments, alkyl groups may contain 1-8 carbon atoms ("$C_1$-$C_8$alkyl"). In certain embodiments, alkyl groups may contain 1-6 carbon atoms ("$C_1$-$C_6$alkyl"). In certain embodiments, alkyl groups contain 1-3 carbon atoms. In still other embodiments, alkyl groups contain 2-3 carbon atoms, and in yet other embodiments alkyl groups contain 1-2 carbon atoms.

"Alkylalkoxy," as used herein, means an alkyl group substituted with an alkoxy group. "Alkoxy," as used herein, refers to an alkyl group, as previously defined, attached to the principal carbon chain through an oxygen ("alkoxy") atom.

"Alkylamino," as used herein, means an alkyl group substituted with an amino group. "Amino," as used herein, refers to —$NH_2$, —NH(alkyl), or —N(alkyl)(alkyl).

"Alkylhydroxy," as used herein, means an alkyl group substituted with an amino group. "Hydroxy" or "hydroxyl," as used herein, refers to —OH.

"Alkylene" refers to a divalent radical of an alkyl group. For example, —$CH_2$—, —$CH_2CH_2$—, —$CH_2CH_2CH_2$—, —$CH_2CH_2CH_2CH_2$—, —$CH_2CH_2CH_2CH_2CH_2$—, and —$CH_2CH_2CH_2CH_2CH_2CH_2$— refer to methylene, ethylene, n-propylene, n-butylene, n-pentylene, and n-hexylene, respectively.

"Carbocycle," as used herein, includes both aromatic (e.g., aryl) and non-aromatic (e.g., cycloalkyl) groups. In certain embodiments, carbocycle groups contain 3-10 carbon atoms ("3 to 10 membered carbocycle"). In certain embodiments, carbocycle groups contain 3-8 carbon atoms ("3 to 8 membered carbocycle"). In certain embodiments, carbocycle groups contain 3-6 carbon atoms ("3 to 6 membered carbocycle"). In certain embodiments, carbocycle groups contain 3-5 carbon atoms ("3 to 5 membered carbocycle").

"Halogen" refers to a radical of any halogen, e.g., —F, —Cl, —Br, or —I.

The terms "heterocycle," "heterocyclyl," and "heterocyclic" as used herein, mean a monocyclic heterocycle, a bicyclic heterocycle, or a tricyclic heterocycle containing at least one heteroatom in the ring.

The monocyclic heterocycle is a 3-, 4-, 5-, 6-, 7, or 8-membered ring containing at least one heteroatom independently chosen from O, N, and S. In some embodiments, the heterocycle is a 3- or 4-membered ring containing one heteroatom chosen from O, N and S. In some embodiments, the heterocycle is a 5-membered ring containing zero or one double bond and one, two or three heteroatoms chosen from O, N and S. In some embodiments, the heterocycle is a 6-, 7-, or 8-membered ring containing zero, one or two double bonds and one, two or three heteroatoms chosen from O, N and S. Representative examples of monocyclic heterocycle include, but are not limited to, azetidinyl, azepanyl, aziridinyl, diazepanyl, 1,3-dioxanyl, 1,3-dioxolanyl, dihydropyranyl (including 3,4-dihydro-2H-pyran-6-yl), 1,3-dithiolanyl, 1,3-dithianyl, imidazolinyl, imidazolidinyl, isothiazolinyl, isothiazolidinyl, isoxazolinyl, isoxazolidinyl, morpholinyl, oxadiazolinyl, oxadiazolidinyl, oxazolinyl, oxazolidinyl, piperazinyl, piperidinyl, pyranyl, pyrazolinyl, pyrazolidinyl, pyrrolinyl, pyrrolidinyl, tetrahydrofuranyl, tetrahydropyranyl (including tetrahydro-2H-pyran-4-yl), tetrahydrothienyl, thiadiazolinyl, thiadiazolidinyl, thiazolinyl, thiazolidinyl, thiomorpholinyl, 1,1-dioxidothiomorpholinyl (thiomorpholine sulfone), thiopyranyl, and trithianyl.

The bicyclic heterocycles of the present disclosure may include a monocyclic heterocycle fused to an aryl group, or a monocyclic heterocycle fused to a monocyclic cycloalkyl, or a monocyclic heterocycle fused to a monocyclic cycloalkenyl, or a monocyclic heterocycle fused to a monocyclic heterocycle having a total of 5 to 12 ring atoms. Examples of bicyclic heterocycles include, but are not limited to, 3,4-dihydro-2H-pyranyl, 1,3-benzodioxolyl, 1,3-benzodithiolyl, 2,3-dihydro-1,4-benzodioxinyl, 2,3-dihydro-1-benzofuranyl, 2,3-dihydro-1-benzothienyl, 2,3-dihydro-1H-indolyl, and 1,2,3,4-tetrahydroquinolinyl.

The terms "heterocycle," "heterocyclyl," and "heterocyclic" encompass heteroaryls. "Heteroaryl" refers to a cyclic moiety having one or more closed rings, with one or more heteroatoms (oxygen, nitrogen or sulfur) in at least one of the rings, wherein at least one of the rings is aromatic, and wherein the ring or rings may independently be fused, and/or bridged. Examples include without limitation phenyl, thiophenyl, triazolyl, pyridinyl, pyrimidinyl, pyridazinyl, and pyrazinyl.

As described herein, compounds of the disclosure may contain "optionally substituted" moieties. In general, the term "substituted," whether preceded by the term "optionally" or not, means that one or more hydrogens of the designated moiety are replaced with a suitable substituent. Unless otherwise indicated, an "optionally substituted" group may have a suitable substituent at each substitutable position of the group, and when more than one position in any given structure may be substituted with more than one substituent chosen from a specified group, the substituent may be either the same or different at each position. Combinations of substituents envisioned under this disclosure are generally those that result in the formation of stable or chemically feasible compounds.

One skilled in the art will be understand that "substitution" or "substituted with" or "absent" is in accordance with permitted valence of the substituted atom and the substituent, and that the substitution or absence results in a stable compound, e.g., which does not spontaneously undergo transformation such as by rearrangement, cyclization, elimination, etc. For purposes of this disclosure, the heteroatoms such as nitrogen may have hydrogen substituents, and/or any permissible substituents of organic compounds described herein which satisfy the valences of the heteroatoms.

"Stable" refers to compounds that are not substantially altered chemically and/or physically when subjected to conditions to allow for their production, detection, and, in certain embodiments, their recovery, purification, and use for one or more of the purposes described herein. In some embodiments, a stable compound or chemically feasible compound is one that is not substantially altered when kept at a temperature of 40° C. or less, in the absence of moisture or other chemically reactive conditions, for at least a week. In some embodiments, the compounds described herein are stable.

Enantiomers taught herein may include "enantiomerically pure" isomers that comprise substantially a single enantiomer, for example, greater than or equal to 90%, 92%, 95%, 98%, or 99%, or equal to 100% of a single enantiomer, at a particular asymmetric center or centers. An "asymmetric center" or "chiral center" refers to a tetrahedral carbon atom that comprises four different substituents.

The compounds described herein may also contain unnatural proportions of atomic isotopes at one or more of the atoms that constitute such compounds. For example, the compounds may be radiolabeled with radioactive isotopes, such as, for example, deuterium ($^2$H), tritium ($^3$H), carbon-13 ($^{13}$C), or carbon-14 ($^{14}$C). All isotopic variations of the compounds described herein, whether radioactive or not, are intended to be encompassed within the scope of the present disclosure. In addition, all tautomeric forms of the compounds described herein are intended to be within the scope of the present disclosure.

In some embodiments, the drug moiety is a splicing modulator compound of Formula (II):

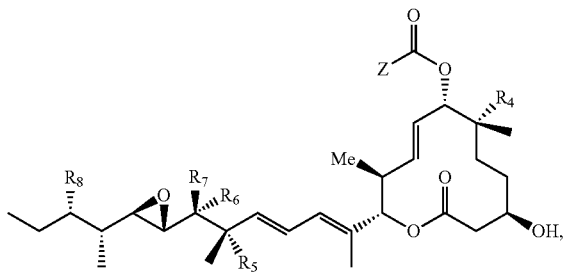

(II)

or a pharmaceutically acceptable salt thereof, wherein:

$R^1$ is chosen from absent, hydrogen, $C_1$-$C_6$ alkyl groups, $C_1$-$C_6$ alkylalkoxy groups, C1-C6 alkylamino groups, $C_1$-$C_6$ alkylcarboxylic acid groups, $C_1$-$C_6$ alkylhydroxy groups, $C_3$-$C_8$ cycloalkyl groups, benzyl groups, $C_3$-$C_8$ heterocyclyl groups, —O—C(=O)—($C_1$-$C_6$ alkyl) groups, and —CD$_3$;

$R^3$ is chosen from hydrogen, $C_1$-$C_6$ alkyl groups, $C_1$-$C_6$ alkylalkoxy groups, $C_1$-$C_6$ alkylamino groups, $C_1$-$C_6$ alkylcarboxylic acid groups, $C_1$-$C_6$ alkylhydroxy groups, $C_3$-$C_8$ cycloalkyl groups, benzyl groups, $C_3$-$C_8$ heterocyclyl groups, and —O—C(=O)—($C_1$-$C_6$ alkyl) groups; and $R^4$, $R^5$, and $R^8$ are each independently chosen from hydrogen, hydroxyl groups, —O—($C_1$-$C_6$ alkyl) groups, —O—C(=O)—($C_1$-$C_6$ alkyl) groups, and $C_1$-$C_6$alkyl groups;

$R^6$ and $R^7$ are each independently chosen from hydrogen, —O—$R^{17}$, —O—C(=O)—$R^{17}$, —O—C(=O)—NR$^{15}$R$^{16}$, $C_1$-$C_6$alkyl groups, and —NR$^{15}$R$^{16}$;

$R^{15}$ and $R^{16}$ are each independently chosen from hydrogen, $R^{17}$, —C(=O)—$R^{17}$, and —C(=O)—O—$R^{17}$;

$R^{17}$ is chosen from hydrogen, $C_1$-$C_6$ alkyl groups, $C_3$-$C_8$ cycloalkyl groups, benzyl groups, and $C_3$-$C_8$ heterocyclyl groups; and Z is chosen from

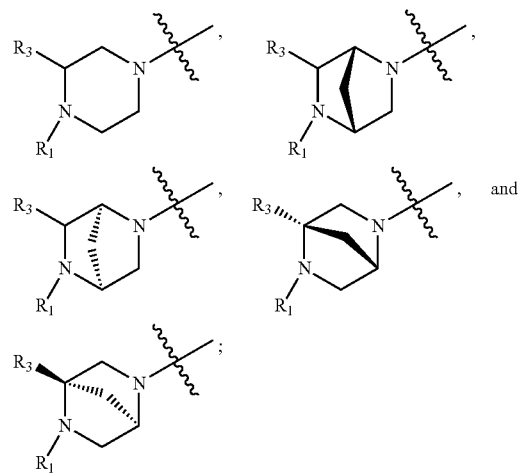

wherein $R^1$, $R^3$, $R^4$, $R^5$, $R^6$, $R^7$, $R^8$, $R^{15}$, $R^{16}$, and $R^{17}$ are each independently substituted with 0 to 3 groups independently chosen from halogens, hydroxyl groups, $C_1$-$C_6$ alkyl groups, —O—($C_1$-$C_6$ alkyl) groups, —$NR^{15}R^{16}$, $C_3$-$C_8$ cycloalkyl groups, $C_1$-$C_6$ alkylhydroxy groups, $C_1$-$C_6$ alkylalkoxy groups, benzyl groups, and $C_3$-$C_8$ heterocyclyl groups, wherein at least one of $R^6$ and $R^7$ is hydrogen.

In some embodiments, $R^1$ is chosen from hydrogen, $C_1$-$C_4$ alkyl groups, $C_1$-$C_4$ alkylcarboxylic acid groups, and $C_3$-$C_8$ cycloalkyl groups. In some embodiments, $R^1$ is hydrogen. In some embodiments, $R^1$ is a $C_1$-$C_4$ alkyl group. In some embodiments, $R^1$ is methyl. In some embodiments, $R^1$ is ethyl. In some embodiments, $R^1$ is a $C_1$-$C_4$ alkylcarboxylic acid group. In some embodiments, $R^1$ is —$CH_2CH_2CH_2CO_2H$. In some embodiments, $R^1$ is a $C_3$-$C_8$ cycloalkyl group. In some embodiments, $R^1$ is cycloheptyl.

In some embodiments, $R^3$ is chosen from hydrogen, $C_1$-$C_4$ alkyl groups, $C_1$-$C_4$ alkylalkoxy groups, $C_1$-$C_4$ alkylcarboxylic acid groups, and $C_1$-$C_4$ alkylhydroxy groups. In some embodiments, $R^3$ is chosen from hydrogen and $C_1$-$C_4$ alkylcarboxylic acid groups. In some embodiments, $R^3$ is hydrogen. In some embodiments, $R^3$ is a $C_1$-$C_4$ alkylcarboxylic acid group. In some embodiments, $R^3$ is —$CH_2CH_2CO_2H$.

In some embodiments, $R^4$ is chosen from hydrogen, hydroxyl groups, —O—($C_1$-$C_4$ alkyl) groups, —O—C(=O)—($C_1$-$C_4$alkyl) groups, and $C_1$-$C_4$alkyl groups. In some embodiments, $R^4$ is hydrogen. In some embodiments, $R^4$ is hydroxyl. In some embodiments, $R^4$ is a —O—($C_1$-$C_4$ alkyl) group. In some embodiments, $R^4$ is —$OCH_3$. In some embodiments, $R^4$ is —$OCH_2CH_3$. In some embodiments, $R^4$ is a —O—C(=O)—($C_1$-$C_4$alkyl) group. In some embodiments, $R^4$ is —O—C(=O)—$CH_3$. In some embodiments, $R^4$ is —O—C(=O)—$CH_2CH_3$. In some embodiments, $R^4$ is a $C_1$-$C_4$ alkyl group. In some embodiments, $R^4$ is methyl. In some embodiments, $R^4$ is ethyl.

In some embodiments, $R^5$ is chosen from hydrogen, hydroxyl groups, —O—($C_1$-$C_4$ alkyl) groups, and $C_1$-$C_4$alkyl groups. In some embodiments, $R^5$ is hydrogen. In some embodiments, $R^5$ is hydroxyl. In some embodiments, $R^5$ is a —O—($C_1$-$C_4$ alkyl) group. In some embodiments, $R^5$ is a $C_1$-$C_4$ alkyl group.

In some embodiments, $R^6$ is hydrogen. In some embodiments, $R^7$ is hydrogen. In some embodiments, $R^6$ is hydrogen and $R^7$ is —O—$R^{17}$. In some embodiments, $R^6$ is hydrogen and $R^7$ is —$OR^{17}$, wherein $R^{17}$ is chosen from hydrogen and $C^1$-$C^4$ alkyl groups. In some embodiments, $R^6$ is hydrogen and $R^7$ is —O—$R^{17}$, wherein $R^{17}$ is hydrogen. In some embodiments, $R^6$ is —O—$R^{17}$ and $R^7$ is hydrogen. In some embodiments, $R^6$ is —O—$R^{17}$ and $R^7$ is hydrogen, wherein $R^{17}$ is chosen from hydrogen and $C^1$-$C^4$ alkyl groups. In some embodiments, $R^6$ is —O—$R^{17}$ and $R^7$ is hydrogen, wherein $R^{17}$ is hydrogen. In some embodiments, $R^6$ is hydrogen and $R^7$ is —$NR^{15}R^{16}$. In some embodiments, $R^6$ is hydrogen and $R^7$ is —$NR^{15}R^{16}$, wherein $R^{15}$ is H and $R^{16}$ is chosen from hydrogen, $R^{17}$, —C(=O)—$R^{17}$, and —C(=O)—O—$R^{17}$. In some embodiments, $R^6$ is hydrogen and $R^7$ is —$NR^{15}R^{16}$, wherein $R^{15}$ is H and $R^{16}$ is chosen from hydrogen, $R^{17}$, —C(=O)—$R^{17}$, and —C(=O)—O—$R^{17}$, and wherein $R^{17}$ is chosen from hydrogen, $C_1$-$C_6$ alkyl groups, $C_3$-$C_8$ cycloalkyl groups, and $C_3$-$C_8$ heterocyclyl groups. In some embodiments, $R^6$ is —O—$R^{17}$. In some embodiments, $R^6$ is —O—C(=O)—$R^{17}$. In some embodiments, $R^6$ is $C_1$-$C_6$ alkyl. In some embodiments, $R^6$ is $C_1$-$C_4$ alkyl. In some embodiments, $R^6$ is $C_1$ alkyl. In some embodiments, $R^6$ is —$NR^{15}R^{16}$. In some embodiments, $R^7$ is —O—$R^{17}$. In some embodiments, $R^7$ is —O—C(=O)—$R^{17}$. In some embodiments, $R^7$ is $C_1$-$C_6$ alkyl. In some embodiments, $R^7$ is $C_1$-$C_4$ alkyl. In some embodiments, $R^7$ is $C_1$ alkyl. In some embodiments, $R^7$ is —$NR^{15}R^{16}$.

In some embodiments, $R^8$ is chosen from hydrogen, hydroxyl groups, —O—($C_1$-$C_4$ alkyl) groups, and ($C_1$-$C_4$ alkyl). In some embodiments, $R^8$ is hydrogen. In some embodiments, $R^8$ is a hydroxyl group. In some embodiments, $R^8$ is an —O—($C_1$-$C_4$ alkyl) group. In some embodiments, $R^8$ is an —O—($C_1$ alkyl) group.

In some embodiments, $R^{15}$ is hydrogen. In some embodiments, $R^{15}$ is $R^{17}$. In some embodiments, $R^{15}$ is —C(=O)—$R^{17}$. In some embodiments, $R^{15}$ is —C(=O)—O—$R^{17}$.

In some embodiments, $R^{16}$ is hydrogen. In some embodiments, $R^{16}$ is $R^{17}$. In some embodiments, $R^{16}$ is —C(=O)—$R^{17}$. In some embodiments, $R^{16}$ is —C(=O)—O—$R^{17}$.

In some embodiments, $R^{17}$ is chosen from hydrogen, $C_1$-$C_4$ alkyl groups, $C_3$-$C_6$ cycloalkyl groups, and $C_3$-$C_8$ heterocyclyl groups. In some embodiments, $R^{17}$ is hydrogen. In some embodiments, $R^{17}$ is a $C_1$-$C_4$ alkyl group. In some embodiments, $R^{17}$ is a $C_1$ alkyl group. In some embodiments, $R^{17}$ is a $C_3$-$C_6$ cycloalkyl group. In some embodiments, $R^{17}$ is a $C_3$ cycloalkyl group. In some embodiments, $R^{17}$ is a $C_4$ cycloalkyl group. In some embodiments, $R^{17}$ is a $C_5$ cycloalkyl group. In some embodiments, $R^{17}$ is a $C_6$ cycloalkyl group. In some embodiments, $R^{17}$ is a $C_3$-$C_8$ heterocyclyl group. In some embodiments, $R^{17}$ is a $C_3$ heterocyclyl group. In some embodiments, $R^{17}$ is a $C_4$ heterocyclyl group. In some embodiments, $R^{17}$ is a $C_5$ heterocyclyl group. In some embodiments, $R^{17}$ is a $C_6$ heterocyclyl group. In some embodiments, $R^{17}$ is a $C_7$ heterocyclyl group. In some embodiments, $R^{17}$ is a $C_8$ heterocyclyl group.

In some embodiments, Z is

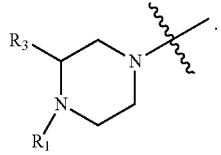

In some embodiments, Z is

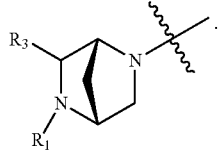

In some embodiments, Z is

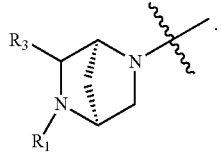

In some embodiments, Z is

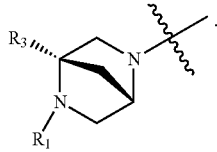

In some embodiments, Z is

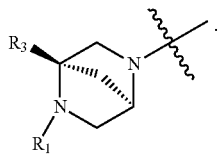

-continued

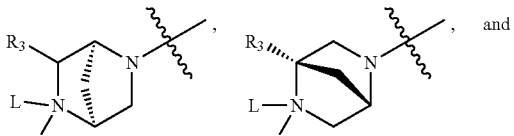

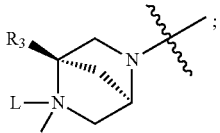

and wherein all other variables are as defined for Formula (II).

In some other embodiments, the drug moiety is a splicing modulator compound of Formula (IV):

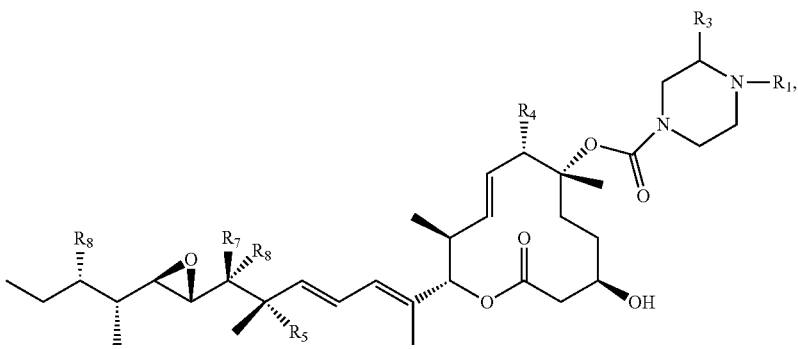

(IV)

In some embodiments, the splicing modulator compound of Formula (II) attaches to the linker L, e.g., in an ADC of Formula (I), as shown in Formula (II-A):

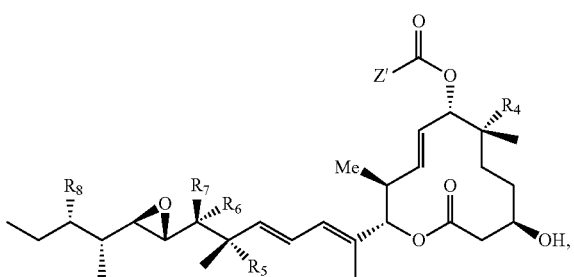

(II-A)

wherein Z' is chosen from

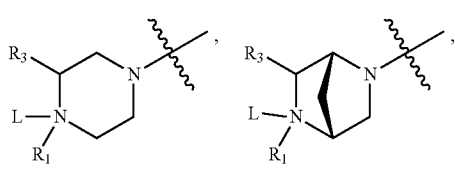

or a pharmaceutically acceptable salt thereof, wherein:

$R^1$ is chosen from hydrogen, $C_1$-$C_6$ alkyl groups, $C_1$-$C_6$ alkylalkoxy groups, $C_1$-$C_6$ alkylamino groups, $C_1$-$C_6$ alkylcarboxylic acid groups, $C_1$-$C_6$ alkylhydroxy groups, $C_3$-$C_8$ cycloalkyl groups, benzyl groups, $C_3$-$C_8$ heterocyclyl groups, —O—C(=O)—($C_1$-$C_6$ alkyl) groups, and —$CD_3$;

$R^3$ is chosen from hydrogen, $C_1$-$C_6$ alkyl groups, $C_1$-$C_6$ alkylalkoxy groups, $C_1$-$C_6$ alkylamino groups, $C_1$-$C_6$ alkylcarboxylic acid groups, $C_1$-$C_6$ alkylhydroxy groups, $C_3$-$C_8$ cycloalkyl groups, benzyl groups, $C_3$-$C_8$ heterocyclyl groups, and —O—C(=O)—($C_1$-$C_6$ alkyl) groups; and $R^4$, $R^5$, and $R^8$ are each independently chosen from hydrogen, hydroxyl groups, —O—($C_1$-$C_6$ alkyl) groups, —O—C(=O)—($C_1$-$C_6$ alkyl) groups, and $C_1$-$C_6$ alkyl groups;

$R^6$ and $R^7$ are each independently chosen from hydrogen, —O—$R^{17}$, —O—C(=O)—$R^{17}$, —O—C(=O)—$NR^{15}R^{16}$, $C_1$-$C_6$ alkyl groups, and —$NR^{15}R^{16}$;

$R^{15}$ and $R^{16}$ are each independently chosen from hydrogen, $R^{17}$, —C(=O)—$R^{17}$, and —C(=O)—O—$R^{17}$; and $R^{17}$ is chosen from hydrogen, $C_1$-$C_6$ alkyl groups, $C_3$-$C_8$ cycloalkyl groups, benzyl groups, and $C_3$-$C_8$ heterocyclyl groups;

wherein $R^1$, $R^3$, $R^4$, $R^5$, $R^6$, $R^7$, $R^8$, $R^{15}$, $R^{16}$, and $R^{17}$ are each independently substituted with 0 to 3 groups independently chosen from halogens, hydroxyl groups, $C_1$-$C_6$ alkyl groups, —O—($C_1$-$C_6$ alkyl) groups, —$NR^{15}R^{16}$, $C_3$-$C_8$ cycloalkyl groups, $C_1$-$C_6$ alkylhydroxy groups, $C_1$-$C_6$ alkylalkoxy groups, benzyl groups, and $C_3$-$C_8$ heterocyclyl groups, wherein at least one of $R^6$ and $R^7$ is hydrogen.

In some embodiments, $R^1$ is chosen from hydrogen, $C_1$-$C_4$ alkyl groups, $C_1$-$C_4$ alkylcarboxylic acid groups, and $C_3$-$C_8$ cycloalkyl groups. In some embodiments, $R^1$ is hydrogen. In some embodiments, $R^1$ is a $C_1$-$C_4$ alkyl group. In some embodiments, $R^1$ is methyl. In some embodiments, $R^1$ is ethyl. In some embodiments, $R^1$ is a $C_1$-$C_4$ alkylcarboxylic acid group. In some embodiments, $R^1$ is —$CH_2CH_2CH_2CO_2H$. In some embodiments, $R^1$ is a $C_3$-$C_8$ cycloalkyl group. In some embodiments, $R^1$ is cycloheptyl.

In some embodiments, $R^3$ is chosen from hydrogen, $C_1$-$C_4$alkyl groups, $C_1$-$C_4$ alkylalkoxy groups, $C_1$-$C_4$ alkylcarboxylic acid groups, and $C_1$-$C_4$ alkylhydroxy groups. In some embodiments, $R^3$ is chosen from hydrogen and $C_1$-$C_4$ alkylcarboxylic acid groups. In some embodiments, $R^3$ is hydrogen. In some embodiments, $R^3$ is a $C_1$-$C_4$ alkylcarboxylic acid group. In some embodiments, $R^3$ is —$CH_2CH_2CO_2H$.

In some embodiments, $R^4$ is chosen from hydrogen, hydroxyl groups, —O—($C_1$-$C_4$ alkyl) groups, —O—C(=O)—($C_1$-$C_4$alkyl) groups, and $C_1$-$C_4$alkyl groups. In some embodiments, $R^4$ is hydrogen. In some embodiments, $R^4$ is hydroxyl. In some embodiments, $R^4$ is a —O—($C_1$-$C_4$ alkyl) group. In some embodiments, $R^4$ is —$OCH_3$. In some embodiments, $R^4$ is —$OCH_2CH_3$. In some embodiments, $R^4$ is a —O—C(=O)—($C_1$-$C_4$ alkyl) group. In some embodiments, $R^4$ is —O—C(=O)—$CH_3$. In some embodiments, $R^4$ is —O—C(=O)—$CH_2CH_3$. In some embodiments, $R^4$ is a $C_1$-$C_4$ alkyl group. In some embodiments, $R^4$ is methyl. In some embodiments, $R^4$ is ethyl.

In some embodiments, $R^5$ is chosen from hydrogen, hydroxyl groups, —O—($C_1$-$C_4$ alkyl) groups, and $C_1$-$C_4$ alkyl groups. In some embodiments, $R^5$ is hydrogen. In some embodiments, $R^5$ is hydroxyl. In some embodiments, $R^5$ is a —O—($C_1$-$C_4$ alkyl) group. In some embodiments, $R^5$ is a $C_1$-$C_4$ alkyl group.

In some embodiments, $R^6$ is hydrogen. In some embodiments, $R^7$ is hydrogen. In some embodiments, $R^6$ is hydrogen and $R^7$ is —O—$R^{17}$. In some embodiments, $R^6$ is hydrogen and $R^7$ is —$OR^{17}$, wherein $R^{17}$ is chosen from hydrogen and $C^1$-$C^4$ alkyl groups. In some embodiments, $R^6$ is hydrogen and $R^7$ is —O—$R^{17}$, wherein $R^{17}$ is hydrogen. In some embodiments, $R^6$ is —O—$R^{17}$ and $R^7$ is hydrogen. In some embodiments, $R^6$ is —O—$R^{17}$ and $R^7$ is hydrogen, wherein $R^{17}$ is chosen from hydrogen and $C^1$-$C^4$ alkyl groups. In some embodiments, $R^6$ is —O—$R^{17}$ and $R^7$ is hydrogen, wherein $R^{17}$ is hydrogen. In some embodiments, $R^6$ is hydrogen and $R^7$ is —$NR^{15}R^{16}$. In some embodiments, $R^6$ is hydrogen and $R^7$ is —$NR^{15}R^{16}$, wherein $R^{15}$ is H and $R^{16}$ is chosen from hydrogen, $R^{17}$, —C(=O)—$R^{17}$, and —C(=O)—O—$R^{17}$. In some embodiments, $R^6$ is hydrogen and $R^7$ is —$NR^{15}R^{16}$, wherein $R^{15}$ is H and $R^{16}$ is chosen from hydrogen, $R^{17}$, —C(=O)—$R^{17}$, and —C(=O)—O—$R^{17}$, and wherein $R^{17}$ is chosen from hydrogen, $C_1$-$C_6$ alkyl groups, $C_3$-$C_8$ cycloalkyl groups, and $C_3$-$C_8$ heterocyclyl groups. In some embodiments, $R^6$ is —O—$R^{17}$. In some embodiments, $R^6$ is —O—C(=O)—$R^{17}$. In some embodiments, $R^6$ is $C_1$-$C_6$ alkyl. In some embodiments, $R^6$ is $C_1$-$C_4$ alkyl. In some embodiments, $R^6$ is $C_1$ alkyl. In some embodiments, $R^6$ is —$NR^{15}R^{16}$.

In some embodiments, $R^7$ is —O—$R^{17}$. In some embodiments, $R^7$ is —O—C(=O)—$R^{17}$. In some embodiments, $R^7$ is $C_1$-$C_6$ alkyl. In some embodiments, $R^7$ is $C_1$-$C_4$ alkyl. In some embodiments, $R^7$ is $C_1$ alkyl. In some embodiments, $R^7$ is —$NR^{15}R^{16}$.

In some embodiments, $R^8$ is chosen from hydrogen, hydroxyl groups, —O—($C_1$-$C_4$ alkyl) groups, and ($C_1$-$C_4$ alkyl). In some embodiments, $R^8$ is hydrogen. In some embodiments, $R^8$ is a hydroxyl group. In some embodiments, $R^8$ is an —O—($C_1$-$C_4$ alkyl) group. In some embodiments, $R^8$ is an —O—($C_1$ alkyl) group.

In some embodiments, $R^{15}$ is hydrogen. In some embodiments, $R^{15}$ is $R^{17}$. In some embodiments, $R^{15}$ is —C(=O)—$R^{17}$. In some embodiments, $R^{15}$ is —C(=O)—O—$R^{17}$.

In some embodiments, $R^{16}$ is hydrogen. In some embodiments, $R^{16}$ is $R^{17}$. In some embodiments, $R^{16}$ is —C(=O)—$R^{17}$. In some embodiments, $R^{16}$ is —C(=O)—O—$R^{17}$.

In some embodiments, $R^{17}$ is chosen from hydrogen, $C_1$-$C_4$ alkyl groups, $C_3$-$C_6$ cycloalkyl groups, and $C_3$-$C_8$ heterocyclyl groups. In some embodiments, $R^{17}$ is hydrogen. In some embodiments, $R^{17}$ is a $C_1$-$C_4$ alkyl group. In some embodiments, $R^{17}$ is a $C_1$ alkyl group. In some embodiments, $R^{17}$ is a $C_3$-$C_6$ cycloalkyl group. In some embodiments, $R^{17}$ is a $C_3$ cycloalkyl group. In some embodiments, $R^{17}$ is a $C_4$ cycloalkyl group. In some embodiments, $R^{17}$ is a $C_5$ cycloalkyl group. In some embodiments, $R^{17}$ is a $C_6$ cycloalkyl group. In some embodiments, $R^{17}$ is a $C_3$-$C_8$ heterocyclyl group. In some embodiments, $R^{17}$ is a $C_3$ heterocyclyl group. In some embodiments, $R^{17}$ is a $C_4$ heterocyclyl group. In some embodiments, $R^{17}$ is a $C_5$ heterocyclyl group. In some embodiments, $R^{17}$ is a $C_6$ heterocyclyl group. In some embodiments, $R^{17}$ is a $C_7$ heterocyclyl group. In some embodiments, $R^{17}$ is a $C_8$ heterocyclyl group.

In some embodiments, the splicing modulator compound of Formula (IV) attaches to the linker L, e.g., in an ADC of Formula (I), as shown in Formula (IV-A):

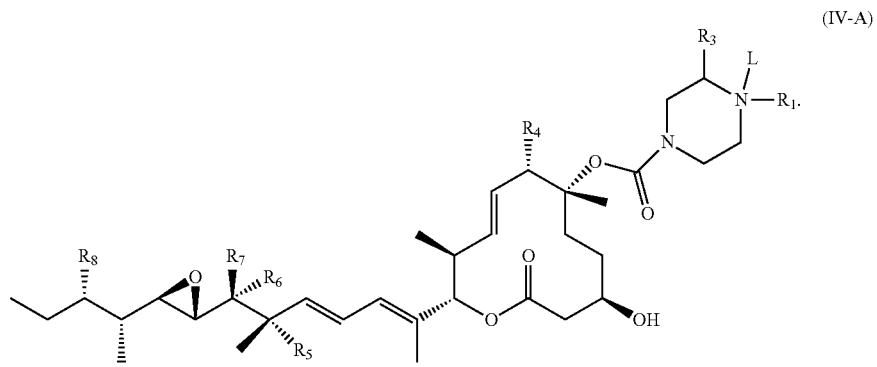

(IV-A)

In some other embodiments, the drug moiety is a splicing modulator compound of Formula (VI):

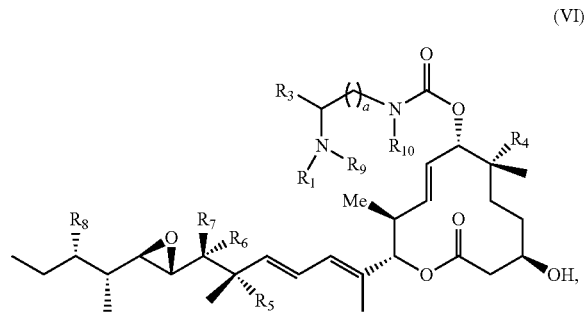

(VI)

or a pharmaceutically acceptable salt thereof, wherein:

$R^1$ and $R^9$ are each independently chosen from hydrogen, $C_1$-$C_6$alkyl groups, $C_1$-$C_6$ alkylalkoxy groups, $C_1$-$C_6$ alkylamino groups, $C_1$-$C_6$ alkylcarboxylic acid groups, $C_1$-$C_6$alkylhydroxy groups, $C_3$-$C_8$ cycloalkyl groups, benzyl groups, $C_3$-$C_8$ heterocyclyl groups, —O—C(=O)—($C_1$-$C_6$ alkyl) groups, and -$CD_3$;

$R^3$ is chosen from hydrogen, $C_1$-$C_6$ alkyl groups, $C_1$-$C_6$ alkylalkoxy groups, $C_1$-$C_6$ alkylamino groups, $C_1$-$C_6$ alkylcarboxylic acid groups, $C_1$-$C_6$ alkylhydroxy groups, $C_3$-$C_8$ cycloalkyl groups, benzyl groups, $C_5$-$C_8$ heterocyclyl groups, and —O—C(=O)—($C_1$-$C_6$alkyl) groups;

$R^4$, $R^5$, and $R^8$ are each independently chosen from hydrogen, hydroxyl groups, —O—($C_1$-$C_6$ alkyl) groups, —O—C(=O)—($C_1$-$C_6$alkyl) groups, and $C_1$-$C_6$alkyl groups;

$R^6$ and $R^7$ are each independently chosen from hydrogen, —O—$R^{17}$, —O—C(=O)—$R^{17}$, —O—C(=O)—$NR^{15}R^{16}$, $C_1$-$C_6$alkyl groups, —$NR^{15}R^{16}$, and a linker;

$R^{10}$ is chosen from hydrogen, $C_1$-$C_6$ alkyl groups, —C(=O)—($C_1$-$C_6$ alkyl) groups, and -$CD_3$;

$R^{15}$ and $R^{16}$ are each independently chosen from hydrogen, $R^{17}$, —C(=O)—$R^{17}$, and —C(=O)—O—$R^{17}$;

$R^{17}$ is chosen from hydrogen, $C_1$-$C_6$ alkyl groups, $C_3$-$C_8$ cycloalkyl groups, benzyl groups, and $C_3$-$C_8$ heterocyclyl groups; and a is 1, 2, 3, 4, 5, 6, 7, 8, 9, or 10;

wherein $R^1$, $R^3$, $R^4$, $R^5$, $R^6$, $R^7$, $R^8$, $R^9$, $R^{10}$, $R^{15}$, $R^{16}$, and $R^{17}$ are each independently substituted with 0 to 3 groups independently chosen from halogens, hydroxyl groups, $C_1$-$C_6$alkyl groups, —O—($C_1$-$C_6$ alkyl) groups, —$NR^{15}R^{16}$, $C_3$-$C_8$ cycloalkyl groups, $C_1$-$C_6$ alkylhydroxy groups, $C_1$-$C_6$ alkylalkoxy groups, benzyl groups, and $C_3$-$C_8$ heterocyclyl groups;

wherein at least one of $R^6$ and $R^7$ is hydrogen; and wherein $R^1$ and $R^9$ cannot both be absent.

In some embodiments, $R^1$ is chosen from hydrogen, $C_1$-$C_4$ alkyl groups, $C_1$-$C_4$ alkylcarboxylic acid groups, and $C_3$-$C_8$ cycloalkyl groups. In some embodiments, $R^1$ is hydrogen. In some embodiments, $R^1$ is a $C_1$-$C_4$ alkyl group. In some embodiments, $R^1$ is methyl. In some embodiments, $R^1$ is ethyl. In some embodiments, $R^1$ is a $C_1$-$C_4$ alkylcarboxylic acid group. In some embodiments, $R^1$ is —$CH_2CH_2CH_2CO_2H$. In some embodiments, $R^1$ is a $C_3$-$C_8$ cycloalkyl group. In some embodiments, $R^1$ is cycloheptyl.

In some embodiments, $R^3$ is chosen from hydrogen, $C_1$-$C_4$alkyl groups, $C_1$-$C_4$ alkylalkoxy groups, $C_1$-$C_4$ alkylcarboxylic acid groups, and $C_1$-$C_4$ alkylhydroxy groups. In some embodiments, $R^3$ is chosen from hydrogen and $C_1$-$C_4$ alkylcarboxylic acid groups. In some embodiments, $R^3$ is hydrogen. In some embodiments, $R^3$ is a $C_1$-$C_4$ alkylcarboxylic acid group. In some embodiments, $R^3$ is —$CH_2CH_2CO_2H$.

In some embodiments, $R^4$ is chosen from hydrogen, hydroxyl groups, —O—($C_1$-$C_4$ alkyl) groups, —O—C(=O)—($C_1$-$C_4$alkyl) groups, and $C_1$-$C_4$alkyl groups. In some embodiments, $R^4$ is hydrogen. In some embodiments, $R^4$ is hydroxyl. In some embodiments, $R^4$ is a —O—($C_1$-$C_4$ alkyl) group. In some embodiments, $R^4$ is —$OCH_3$. In some embodiments, $R^4$ is —$OCH_2CH_3$. In some embodiments, $R^4$ is a —O—C(=O)—($C_1$-$C_4$ alkyl) group. In some embodiments, $R^4$ is —O—C(=O)—$CH_3$. In some embodiments, $R^4$ is —O—C(=O)—$CH_2CH_3$. In some embodiments, $R^4$ is a $C_1$-$C_4$ alkyl group. In some embodiments, $R^4$ is methyl. In some embodiments, $R^4$ is ethyl.

In some embodiments, $R^5$ is chosen from hydrogen, hydroxyl groups, —O—($C_1$-$C_4$ alkyl) groups, and $C_1$-$C_4$ alkyl groups. In some embodiments, $R^5$ is hydrogen. In some embodiments, $R^5$ is hydroxyl. In some embodiments, $R^5$ is a —O—($C_1$-$C_4$ alkyl) group. In some embodiments, $R^5$ is a $C_1$-$C_4$ alkyl group.

In some embodiments, $R^9$ is chosen from absent, hydrogen, $C_1$-$C_4$ alkyl groups, —(C=O)—($C_1$-$C_4$ alkyl) groups, and -$CD_3$. In some embodiments, $R^9$ is absent. In some embodiments, $R^9$ is hydrogen. In some embodiments, $R^9$ is a $C_1$-$C_4$ alkyl group. In some embodiments, the $C_1$-$C_4$ alkyl group is methyl. In some embodiments, the $C_1$-$C_4$ alkyl group is ethyl. In some embodiments, $R^9$ is a —(C=O)—($C_1$-$C_4$ alkyl) group. In some embodiments, the —(C=O)—($C_1$-$C_4$ alkyl) group is —(C=O)-methyl. In some embodiments, $R^9$ is —$CD_3$.

In some embodiments, $R^{10}$ is chosen from hydrogen, $C_1$-$C_4$ alkyl groups, —(C=O)—($C_1$-$C_4$ alkyl) groups, and -$CD_3$. In some embodiments, $R^{10}$ is hydrogen. In some embodiments, $R^{10}$ is a $C_1$-$C_4$ alkyl group. In some embodiments, the $C_1$-$C_4$ alkyl group is methyl. In some embodiments, the $C_1$-$C_4$ alkyl group is ethyl. In some embodiments, $R^{10}$ is a —(C=O)—($C_1$-$C_4$ alkyl) group. In some embodiments, the —(C=O)—($C_1$-$C_4$ alkyl) group is —(C=O)-methyl. In some embodiments, $R^{10}$ is —$CD_3$.

In some embodiments, $R^6$ is hydrogen. In some embodiments, $R^7$ is hydrogen. In some embodiments, $R^6$ is hydrogen and $R^7$ is —O—$R^{17}$. In some embodiments, $R^6$ is hydrogen and $R^7$ is —$OR^{17}$, wherein $R^{17}$ is chosen from hydrogen and $C^1$-$C^4$ alkyl groups. In some embodiments, $R^6$ is hydrogen and $R^7$ is —O—$R^{17}$, wherein $R^{17}$ is hydrogen. In some embodiments, $R^6$ is —O—$R^{17}$ and $R^7$ is hydrogen. In some embodiments, $R^6$ is —O—$R^{17}$ and $R^7$ is hydrogen, wherein $R^{17}$ is chosen from hydrogen and $C^1$-$C^4$ alkyl groups. In some embodiments, $R^6$ is —O—$R^{17}$ and $R^7$ is hydrogen, wherein $R^{17}$ is hydrogen. In some embodiments, $R^6$ is hydrogen and $R^7$ is —$NR^{15}R^{16}$. In some embodiments, $R^6$ is hydrogen and $R^7$ is —$NR^{15}R^{16}$, wherein $R^{15}$ is H and $R^{16}$ is chosen from hydrogen, $R^{17}$, —C(=O)—$R^{17}$, and —C(=O)—O—$R^{17}$. In some embodiments, $R^6$ is hydrogen and $R^7$ is —$NR^{15}R^{16}$, wherein $R^{15}$ is H and $R^{16}$ is chosen from hydrogen, $R^{17}$, —C(=O)—$R^{17}$, and —C(=O)—O—$R^{17}$, and wherein $R^{17}$ is chosen from hydrogen, $C_1$-$C_6$ alkyl groups, $C_3$-$C_8$ cycloalkyl groups, and $C_3$-$C_8$ heterocyclyl groups. In some embodiments, $R^6$ is —O—$R^{17}$. In some embodiments, $R^6$ is —O—C(=O)—$R^{17}$. In some embodiments, $R^6$ is $C_1$-$C_6$ alkyl. In some embodiments, $R^6$ is $C_1$-$C_4$ alkyl. In some embodiments, $R^6$ is $C_1$ alkyl. In some embodiments, $R^6$ is —$NR^{15}R^{16}$.

In some embodiments, $R^7$ is —O—$R^{17}$. In some embodiments, $R^7$ is —O—C(=O)—$R^{17}$. In some embodiments, $R^7$ is $C_1$-$C_6$ alkyl. In some embodiments, $R^7$ is $C_1$-$C_4$ alkyl. In some embodiments, $R^7$ is $C_1$ alkyl. In some embodiments, $R^7$ is —$NR^{15}R^{16}$.

In some embodiments, $R^8$ is chosen from hydrogen, hydroxyl groups, —O—($C_1$-$C_4$ alkyl) groups, and ($C_1$-$C_4$ alkyl). In some embodiments, $R^8$ is hydrogen. In some embodiments, $R^8$ is a hydroxyl group. In some embodiments, $R^8$ is an —O—($C_1$-$C_4$ alkyl) group. In some embodiments, $R^8$ is an —O—($C_1$ alkyl) group.

In some embodiments, $R^{15}$ is hydrogen. In some embodiments, $R^{15}$ is $R^{17}$. In some embodiments, $R^{15}$ is —C(=O)—$R^{17}$. In some embodiments, $R^{15}$ is —C(=O)—O—$R^{17}$.

In some embodiments, $R^{16}$ is hydrogen. In some embodiments, $R^{16}$ is $R^{17}$. In some embodiments, $R^{16}$ is —C(=O)—$R^{17}$. In some embodiments, $R^{16}$ is —C(=O)—O—$R^{17}$.

In some embodiments, $R^{17}$ is chosen from hydrogen, $C_1$-$C_4$ alkyl groups, $C_3$-$C_6$ cycloalkyl groups, and $C_3$-$C_8$ heterocyclyl groups. In some embodiments, $R^{17}$ is hydrogen. In some embodiments, $R^{17}$ is a $C_1$-$C_4$ alkyl group. In some embodiments, $R^{17}$ is a $C_1$ alkyl group. In some embodiments, $R^{17}$ is a $C_3$-$C_6$ cycloalkyl group. In some embodiments, $R^{17}$ is a $C_3$ cycloalkyl group. In some embodiments, $R^{17}$ is a $C_4$ cycloalkyl group. In some embodiments, $R^{17}$ is a $C_5$ cycloalkyl group. In some embodiments, $R^{17}$ is a $C_6$ cycloalkyl group. In some embodiments, $R^{17}$ is a $C_3$-$C_8$ heterocyclyl group. In some embodiments, $R^{17}$ is a $C_3$ heterocyclyl group. In some embodiments, $R^{17}$ is a $C_4$ heterocyclyl group. In some embodiments, $R^{17}$ is a $C_5$ heterocyclyl group. In some embodiments, $R^{17}$ is a $C_6$ heterocyclyl group. In some embodiments, $R^{17}$ is a $C_7$ heterocyclyl group. In some embodiments, $R^{17}$ is a $C_8$ heterocyclyl group.

In some embodiments, a is 1, 2, 3, 4, 5, 6, 7, 8, 9, or 10. In some embodiments, a is 1, 2, 3, 4, 5, or 6. In some embodiments, a is 1, 2, 3, 4, or 5. In some embodiments, a is 1, 2, 3, or 4. In some embodiments, a is 1, 2, or 3. In some embodiments, a is 1 or 2. In some embodiments, a is 1. In some embodiments, a is 2. In some embodiments, a is 3. In some embodiments, a is 4. In some embodiments, a is 5. In some embodiments, a is 6. In some embodiments, a is 7. In some embodiments, a is 8. In some embodiments, a is 9. In some embodiments, a is 10.

In some embodiments, the splicing modulator compound of Formula (VI) attaches to the linker L, e.g., in an ADC of Formula (I), as shown in Formula (VI-A):

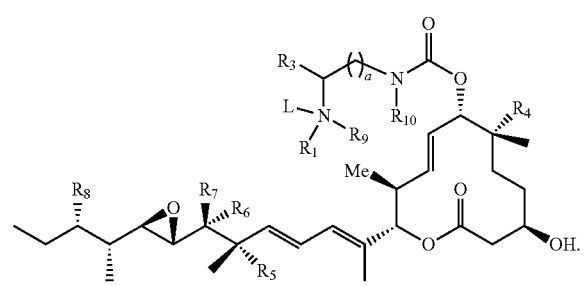

(VI-A)

In some other embodiments, the drug moiety is a splicing modulator compound of Formula (VIII):

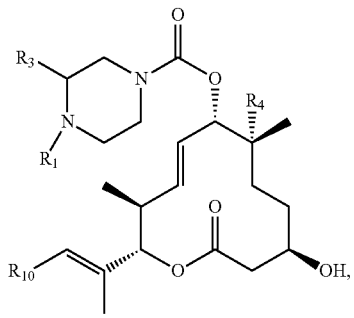

(VIII)

or a pharmaceutically acceptable salt thereof, wherein:

$R^1$ is chosen from absent, hydrogen, $C_1$-$C_6$ alkyl groups, $C_1$-$C_6$ alkylalkoxy groups, $C_1$-$C_6$ alkylamino groups, $C_1$-$C_6$ alkylcarboxylic acid groups, $C_1$-$C_6$ alkylhydroxy groups, $C_3$-$C_8$ cycloalkyl groups, benzyl groups, $C_3$-$C_8$ heterocyclyl groups, —O—C(=O)—($C_1$-$C_6$ alkyl) groups, and —$CD_3$;

$R^3$ is chosen from hydrogen, $C_1$-$C_6$ alkyl groups, $C_1$-$C_6$ alkylalkoxy groups, $C_1$-$C_6$ alkylamino groups, $C_1$-$C_6$ alkylcarboxylic acid groups, $C_1$-$C_6$ alkylhydroxy groups, $C_3$-$C_8$ cycloalkyl groups, benzyl groups, $C_3$-$C_8$ heterocyclyl groups, and —O—C(=O)—($C_1$-$C_6$ alkyl) groups;

$R^4$ is chosen from hydrogen, hydroxyl groups, —O—($C_1$-$C_6$ alkyl) groups, —O—C(=O)—($C_1$-$C_6$ alkyl) groups, and $C_1$-$C_6$alkyl groups; and $R^{10}$ is chosen from 3 to 10 membered carbocycles and 3 to 10 membered heterocycles, each of which is substituted with 0 to 3 $R^a$, wherein each $R^a$ is independently chosen from halogens, $C_1$-$C_6$alkyl groups, —O—($C_1$-$C_6$)alkyl groups, $C_1$-$C_6$alkylalkoxy groups, $C_1$-$C_6$ alkylhydroxy groups, —S(=O)$_w$-(4 to 7 membered heterocycles), 4 to 7 membered carbocycles, and 4 to 7 membered heterocycles;

$R^{15}$ and $R^{16}$ are each independently chosen from hydrogen, $R^{17}$, —C(=O)—$R^{17}$, and —C(=O)—O—$R^{17}$; and $R^{17}$ is chosen from hydrogen, $C_1$-$C_6$ alkyl groups, $C_3$-$C_8$ cycloalkyl groups, benzyl groups, and $C_3$-$C_8$ heterocyclyl groups;

wherein $R^1$, $R^3$, $R^4$, $R^{10}$, $R^{15}$, $R^{16}$, and $R^{17}$ are each independently substituted with 0 to 3 groups independently chosen from halogens, hydroxyl groups, $C_1$-$C_6$ alkyl groups, —O—($C_1$-$C_6$ alkyl) groups, —$NR^{15}R^{16}$, O3-08 cycloalkyl groups, $C_1$-$C_6$ alkylhydroxy groups, $C_1$-$C_6$ alkylalkoxy groups, benzyl groups, and $C_3$-$C_8$ heterocyclyl groups; and wherein each $R^a$ is independently substituted with 0 to 3 groups independently chosen from halogens, hydroxyl groups, —$NR^{15}R^{16}$, $C_1$-$C_6$ alkyl groups, —(C=O)—($C_1$-$C_6$ alkyl) groups, —(C=O)—($C_1$-$C_6$alkyl)-($C_3$-$C_{10}$ heterocyclyl groups), and $C_1$-$C_6$ alkylcarboxylic acid groups, each of which is substituted with 0, 1, or 2 groups independently chosen from halogens, hydroxyl groups, —$NR^{15}R^{16}$, and $C_1$-$C_3$alkyl groups; and w is 0, 1, or 2.

In some embodiments, $R^1$ is chosen from absent, hydrogen, $C_1$-$C_4$ alkyl groups, $C_1$-$C_4$ alkylcarboxylic acid groups, and $C_3$-$C_8$ cycloalkyl groups. In some embodiments, $R^1$ is hydrogen. In some embodiments, $R^1$ is a $C_1$-$C_4$ alkyl group. In some embodiments, $R^1$ is methyl. In some embodiments, $R^1$ is ethyl. In some embodiments, $R^1$ is a $C_1$-$C_4$ alkylcarboxylic acid group. In some embodiments, $R^1$ is —$CH_2CH_2CH_2CO_2H$. In some embodiments, $R^1$ is a $C_3$-$C_8$ cycloalkyl group. In some embodiments, $R^1$ is cycloheptyl.

In some embodiments, $R^3$ is chosen from hydrogen, $C_1$-$C_4$alkyl groups, $C_1$-$C_4$ alkylalkoxy groups, $C_1$-$C_4$ alkylcarboxylic acid groups, and $C_1$-$C_4$ alkylhydroxy groups. In some embodiments, $R^3$ is chosen from hydrogen and $C_1$-$C_4$ alkylcarboxylic acid groups. In some embodiments, $R^3$ is hydrogen. In some embodiments, $R^3$ is a $C_1$-$C_4$ alkylcarboxylic acid group. In some embodiments, $R^3$ is —$CH_2CH_2CO_2H$.

In some embodiments, $R^4$ is chosen from hydrogen, hydroxyl groups, —O—($C_1$-$C_4$ alkyl) groups, —O—C(=O)—($C_1$-$C_4$alkyl) groups, and $C_1$-$C_4$alkyl groups. In some embodiments, $R^4$ is hydrogen. In some embodiments, $R^4$ is hydroxyl. In some embodiments, $R^4$ is a —O—($C_1$-$C_4$ alkyl) group. In some embodiments, $R^4$ is —$OCH_3$. In some embodiments, $R^4$ is —$OCH_2CH_3$. In some embodiments, $R^4$ is a —O—C(=O)—($C_1$-$C_4$alkyl) group. In some embodiments, $R^4$ is —O—C(=O)—$CH_3$. In some embodiments, $R^4$ is —O—C(=O)—$CH_2CH_3$. In some embodiments, $R^4$ is a $C_1$-$C_4$ alkyl group. In some embodiments, $R^4$ is methyl. In some embodiments, $R^4$ is ethyl.

In some embodiments, $R^{10}$ is chosen from 6 to 9 membered carbocycles and 6 to 9 membered heterocycles, each of which is substituted with 0 to 2 $R^a$, wherein each $R^a$ is independently substituted with 0 to 3 groups independently chosen from halogens, hydroxyl groups, $C_1$-$C_6$ alkyl groups, —(C=O)—($C_1$-$C_6$ alkyl) groups, —(C=O)—($C_1$-$C_6$ alkyl)-(3 to 10 membered heterocycle) groups, and $C_1$-$C_6$ alkylcarboxylic acid groups.

In some embodiments, the carbocycle is a phenyl substituted with 0 to 2 $R^a$, wherein each $R^a$ is independently substituted with 0 to 3 groups independently chosen from halogens, hydroxyl groups, $C_1$-$C_6$ alkyl groups, —(C=O)—($C_1$-$C_6$ alkyl) groups, —(C=O)—($C_1$-$C_6$ alkyl)-(3 to 10 membered heterocycle) groups, and $C_1$-$C_6$alkylcarboxylic acid groups. In some embodiments, the phenyl is substituted with 2 $R^a$, wherein each $R^a$ is independently substituted with 0 to 3 groups independently chosen from halogens, hydroxyl groups, $C_1$-$C_6$ alkyl groups, —(C=O)—($C_1$-$C_6$ alkyl) groups, —(C=O)—($C_1$-$C_6$ alkyl)-(3 to 10 membered heterocycle) groups, and $C_1$-$C_6$ alkylcarboxylic acid groups. In some embodiments, the phenyl is

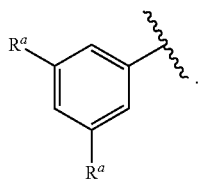

In some embodiments, the heterocycle is a 9 membered heterocycle substituted with 0 to 2 $R^a$, wherein each $R^a$ is independently substituted with 0 to 3 groups independently chosen from halogens, hydroxyl groups, $C_1$-$C_6$ alkyl groups, —(C=O)—($C_1$-$C_6$ alkyl) groups, —(C=O)—($C_1$-$C_6$ alkyl)-(3 to 10 membered heterocycle) groups, and $C_1$-$C_5$ alkylcarboxylic acid groups. In some embodiments, the 9 membered heterocycle is

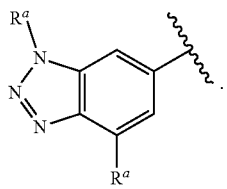

In some embodiments, $R^a$ is chosen from halogens, 3 to 10 membered carbocycles, and 3 to 10 membered heterocycles, wherein each $R^a$ is independently substituted with 0 to 3 groups independently chosen from halogens, hydroxyl groups, $C_1$-$C_6$ alkyl groups, —(C=O)—($C_1$-$C_6$ alkyl) groups, —(C=O)—($C_1$-$C_6$ alkyl)-(3 to 10 membered heterocycle) groups, and $C_1$-$C_6$ alkylcarboxylic acid groups. In some embodiments, $R^a$ is chosen from halogens,

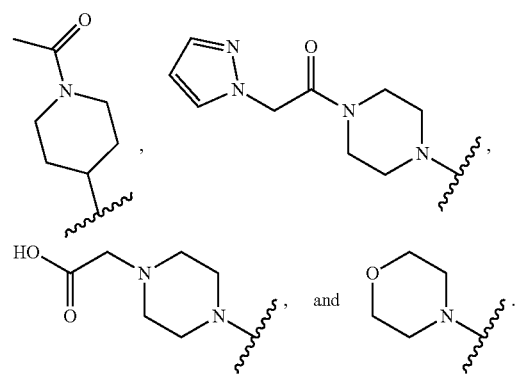

In some embodiments, $R^{15}$ is hydrogen. In some embodiments, $R^{15}$ is $R^{17}$. In some embodiments, $R^{15}$ is —C(=O)—$R^{17}$. In some embodiments, $R^{15}$ is —C(=O)—O—$R^{17}$.

In some embodiments, $R^{16}$ is hydrogen. In some embodiments, $R^{16}$ is $R^{17}$. In some embodiments, $R^{16}$ is —C(=O)—$R^{17}$. In some embodiments, $R^{16}$ is —C(=O)—O—$R^{17}$.

In some embodiments, $R^{17}$ is chosen from hydrogen, $C_1$-$C_4$ alkyl groups, $C_3$-$C_6$ cycloalkyl groups, and $C_3$-$C_8$ heterocyclyl groups. In some embodiments, $R^{17}$ is hydrogen. In some embodiments, $R^{17}$ is a $C_1$-$C_4$ alkyl group. In some embodiments, $R^{17}$ is a $C_1$ alkyl group. In some embodiments, $R^{17}$ is a $C_3$-$C_6$ cycloalkyl group. In some embodiments, $R^{17}$ is a $C_3$ cycloalkyl group. In some embodiments, $R^{17}$ is a $C_4$ cycloalkyl group. In some embodiments, $R^{17}$ is a $C_5$ cycloalkyl group. In some embodiments, $R^{17}$ is a $C_6$ cycloalkyl group. In some embodiments, $R^{17}$ is a $C_3$-$C_8$ heterocyclyl group. In some embodiments, $R^{17}$ is a $C_3$ heterocyclyl group. In some embodiments, $R^{17}$ is a $C_4$ heterocyclyl group. In some embodiments, $R^{17}$ is a $C_5$ heterocyclyl group. In some embodiments, $R^{17}$ is a $C_6$ heterocyclyl group. In some embodiments, $R^{17}$ is a $C_7$ heterocyclyl group. In some embodiments, $R^{17}$ is a 08 heterocyclyl group.

In some embodiments, the splicing modulator compound of Formula (VIII) attaches to the linker L, e.g., in an ADC of Formula (I), as shown in Formula (VIII-A):

(VIII-A)

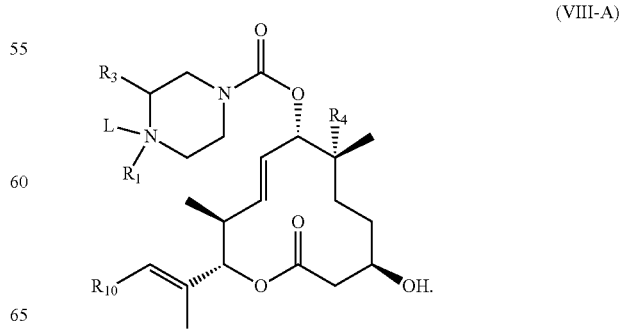

In some embodiments, the drug moiety is a splicing modulator selected from D1 and D2.

In some embodiments, the drug moiety is D1 or a pharmaceutically acceptable salt thereof. In some embodiments, the structure of the D1 drug moiety used in the disclosed ADCs is shown below:

D1

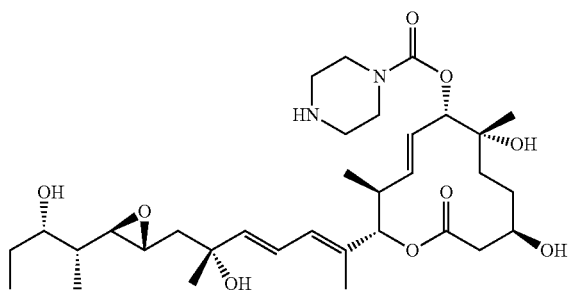

In some embodiments, the linker in the ADCs described herein (e.g., ADCs of Formula (I)) covalently attaches to the D1 drug moiety via an amine on the piperazine group. In various embodiments, the drug moiety is a derivative of D1. In some embodiments, the D1 derivative retains at least one biological function or activity as D1 (e.g., SF3b complex binding, in vitro splicing activity, cytotoxicity) but has an altered chemical structure.

In some embodiments, the drug moiety is D2 or a pharmaceutically acceptable salt thereof. In some embodiments, the structure of the D2 drug moiety used in the disclosed ADCs is shown below:

D2

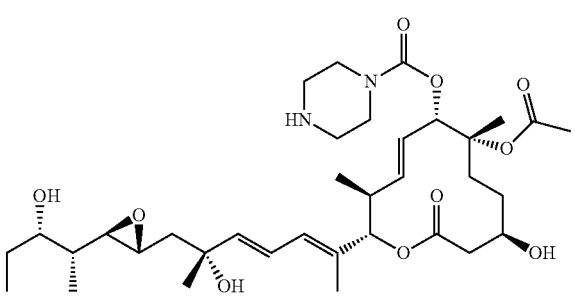

In some embodiments, the linker in the ADCs described herein (e.g., ADCs of Formula (I)) covalently attaches to the D2 drug moiety via an amine on the piperazine group. In some embodiments, the drug moiety is a derivative of D2. In some embodiments, the D2 derivative retains at least one biological function or activity as D2 (e.g., SF3b complex binding, in vitro splicing activity, cytotoxicity) but has an altered chemical structure.

In some embodiments, the splicing modulator comprises D1:

(D1)

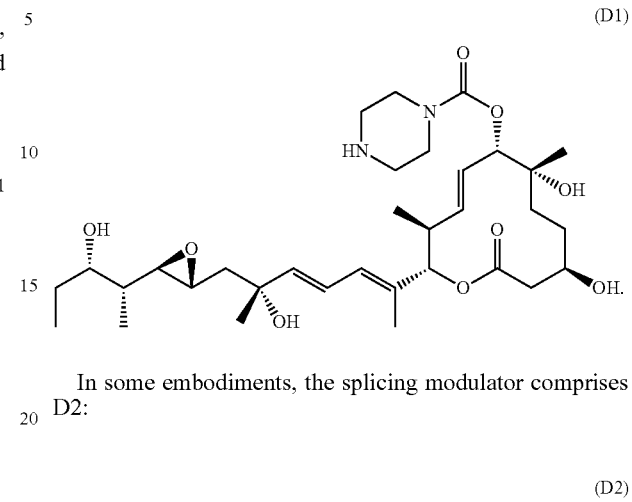

In some embodiments, the splicing modulator comprises D2:

(D2)

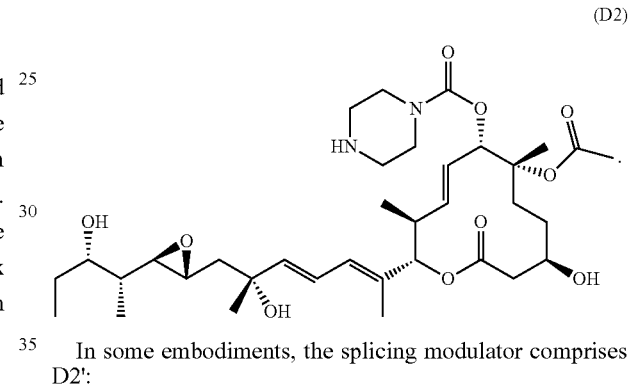

In some embodiments, the splicing modulator comprises D2':

(D2')

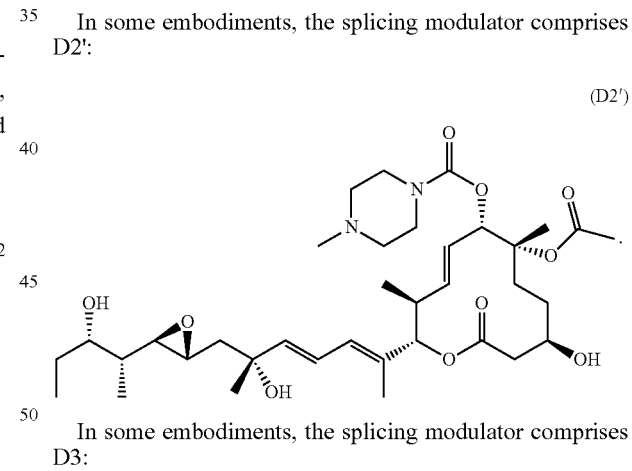

In some embodiments, the splicing modulator comprises D3:

(D3)

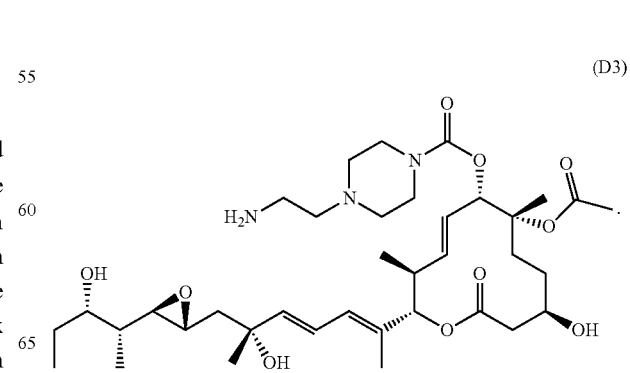

In some embodiments, the splicing modulator comprises D4:
In some embodiments, the splicing modulator comprises D6:
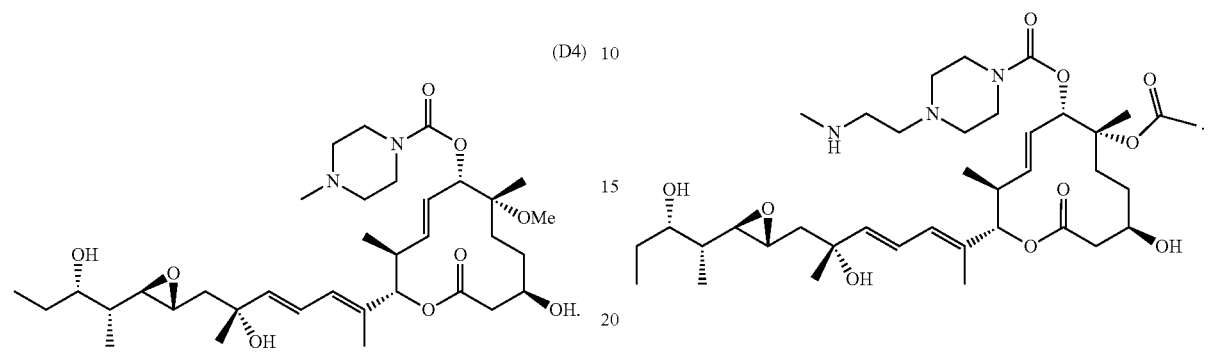
In some embodiments, the splicing modulator comprises D7:
In some embodiments, the splicing modulator comprises D5:
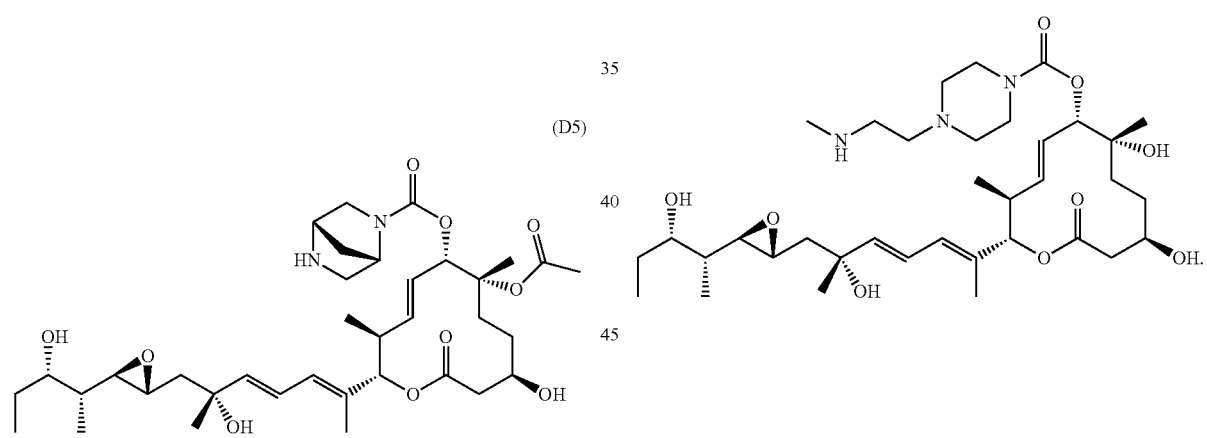
In some embodiments, the splicing modulator comprises D8:
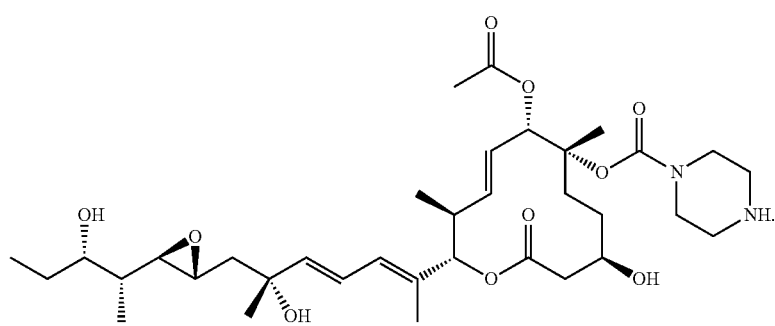

In some embodiments, the splicing modulator comprises D9:
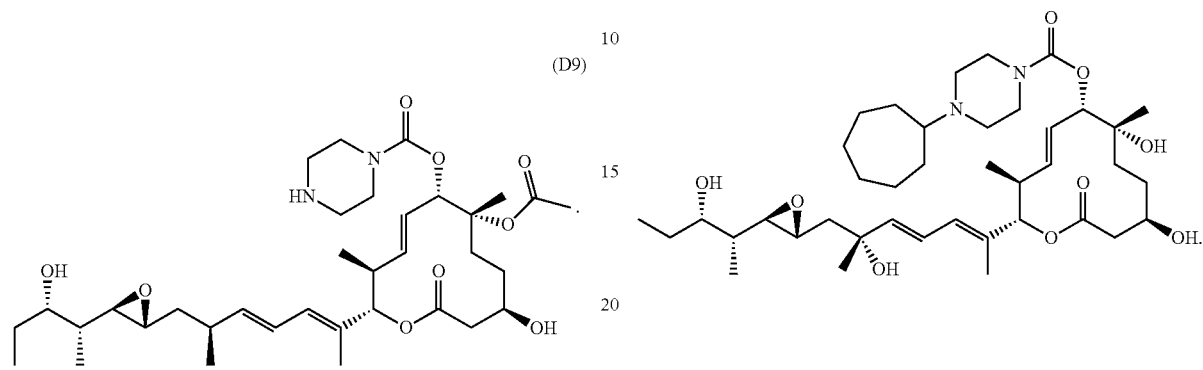
In some embodiments, the splicing modulator comprises D10:
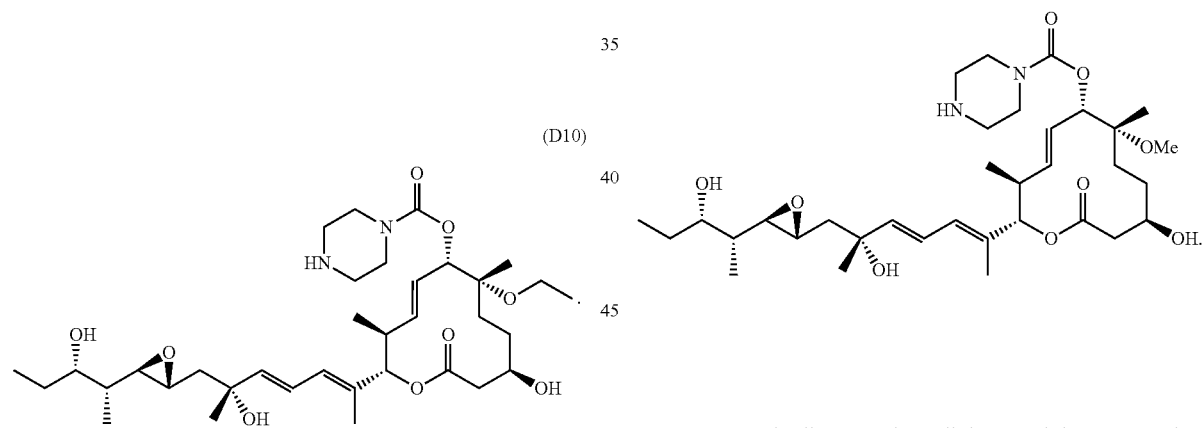
In some embodiments, the splicing modulator comprises D11:
In some embodiments, the splicing modulator comprises D12:
In some embodiments, the splicing modulator comprises D13:
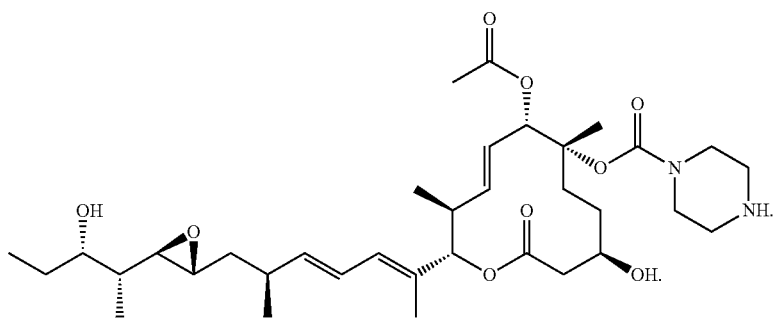

In some embodiments, the splicing modulator comprises D14:
(D14)
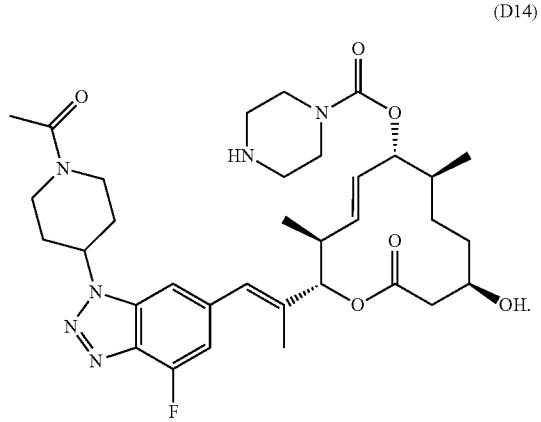 [SMILES: CC(=O)N1CCC(n2nnc3c(F)cc(/C=C(\C)[C@H]4OC(=O)C[C@H](O)CC[C@H](C)[C@@H](OC(=O)N5CCNCC5)/C=C/[C@@H]4C)cc32)CC1]
In some embodiments, the splicing modulator comprises D15:
(D15)
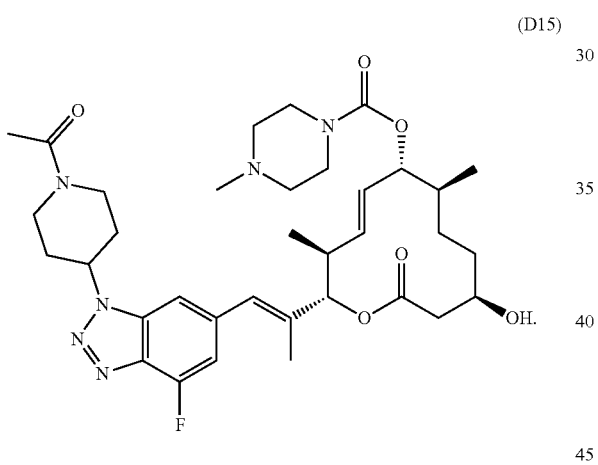
In some embodiments, the splicing modulator comprises D16:
(D16)
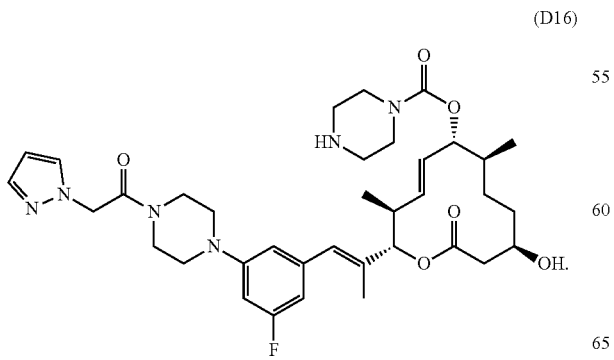
In some embodiments, the splicing modulator comprises D17:
(D17)
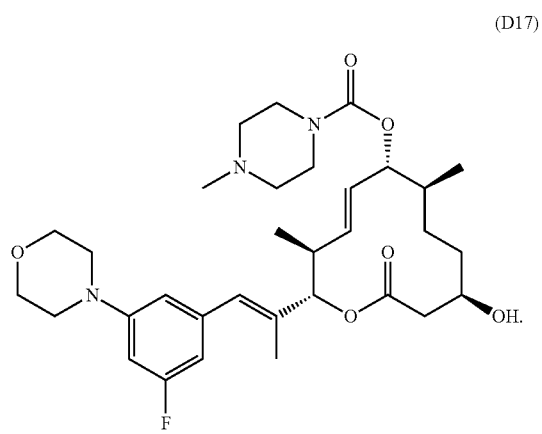 [SMILES: C/C(=C\c1cc(F)cc(N2CCOCC2)c1)[C@H]1OC(=O)C[C@H](O)CC[C@H](C)[C@@H](OC(=O)N2CCN(C)CC2)/C=C/[C@@H]1C]
In some embodiments, the splicing modulator comprises D18:
(D18)
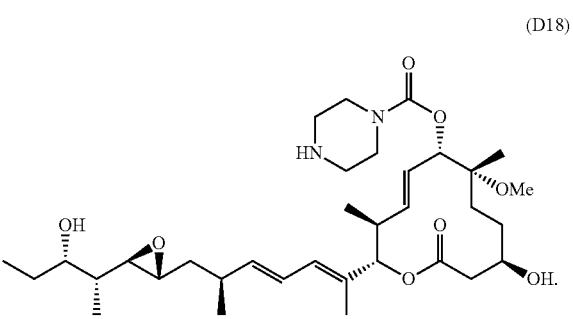 [SMILES: CC[C@H](O)[C@@H](C)[C@H]1O[C@@H]1C[C@H](C)/C=C/C=C(\C)[C@H]1OC(=O)C[C@H](O)CC[C@@](C)(OC)[C@@H](OC(=O)N2CCNCC2)/C=C/[C@@H]1C]
In some embodiments, the splicing modulator comprises D19:
(D19)
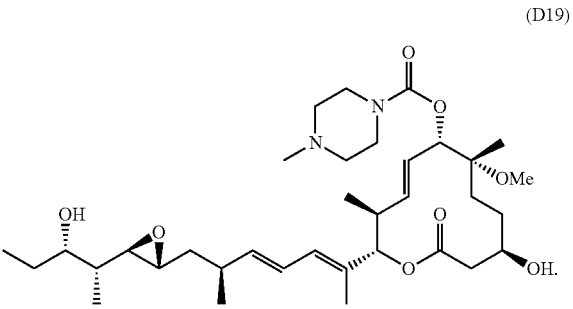 [SMILES: CC[C@H](O)[C@@H](C)[C@H]1O[C@@H]1C[C@H](C)/C=C/C=C(\C)[C@H]1OC(=O)C[C@H](O)CC[C@@](C)(OC)[C@@H](OC(=O)N2CCN(C)CC2)/C=C/[C@@H]1C]

In some embodiments, the splicing modulator comprises D20:

(D20)

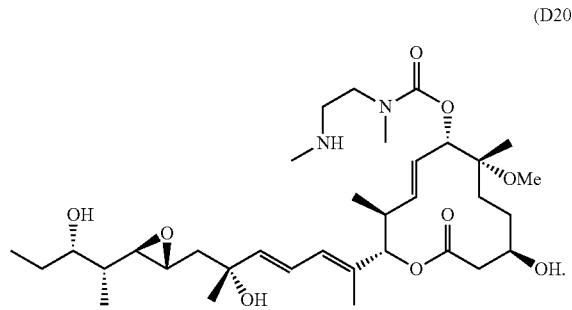

In some embodiments, the splicing modulator comprises D21:

(D21)

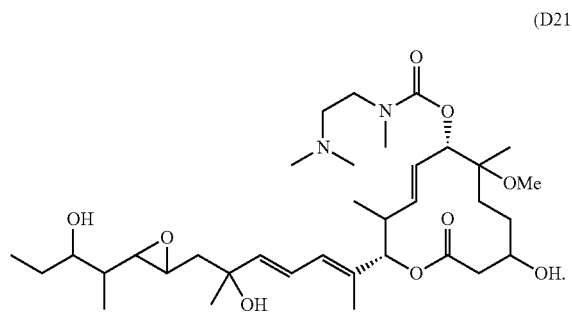

In some embodiments, the splicing modulator comprises D22:

(D22)

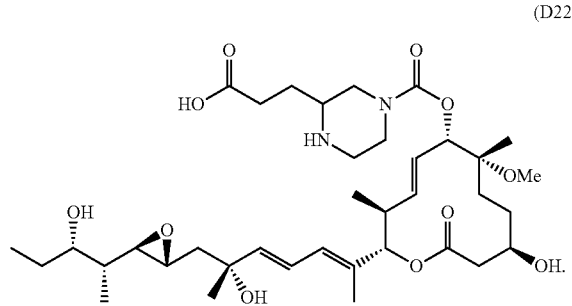

In some embodiments, the splicing modulator comprises D23:

(D23)

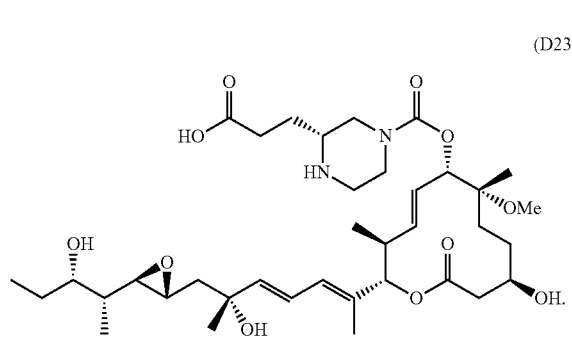

In some embodiments, the splicing modulator comprises D24:

(D24)

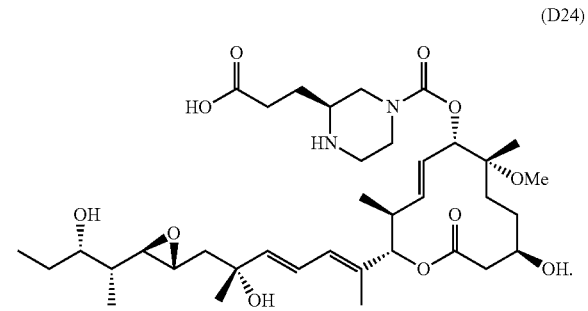 [SMILES: CC[C@H](O)[C@@H](C)[C@H]1O[C@@H]1C[C@@](C)(O)/C=C/C=C(\C)[C@H]1OC(=O)C[C@H](O)CC[C@@](C)(OC)[C@@H](OC(=O)N2CCN[C@@H](CCC(=O)O)C2)/C=C/[C@@H]1C]

In some embodiments, the splicing modulator comprises D25:

(D25)

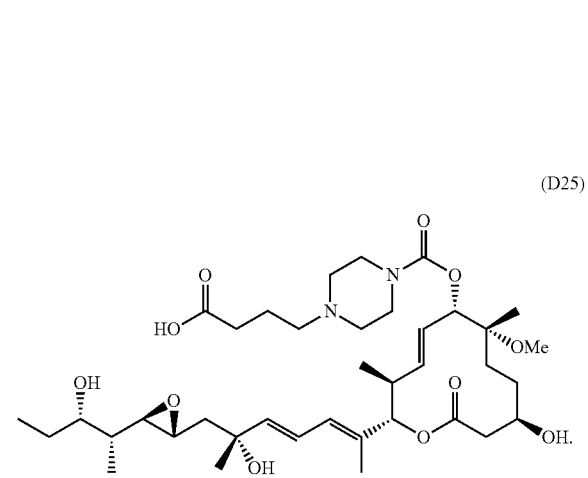 [SMILES: CC[C@H](O)[C@@H](C)[C@H]1O[C@@H]1C[C@@](C)(O)/C=C/C=C(\C)[C@H]1OC(=O)C[C@H](O)CC[C@@](C)(OC)[C@@H](OC(=O)N2CCN(CCCC(=O)O)CC2)/C=C/[C@@H]1C]

In some embodiments, the splicing modulator comprises D26:

(D26)

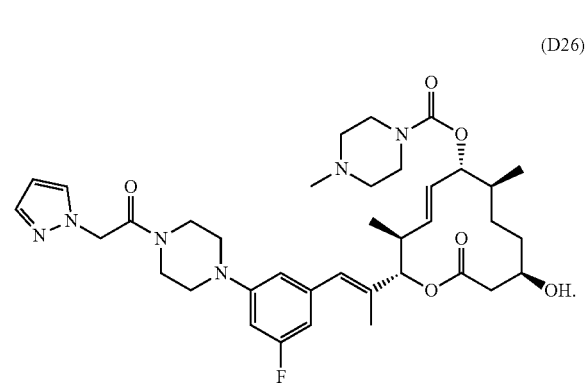 [SMILES: C/C(=C\c1cc(F)cc(N2CCN(C(=O)Cn3cccn3)CC2)c1)[C@H]1OC(=O)C[C@H](O)CC[C@H](C)[C@@H](OC(=O)N2CCN(C)CC2)/C=C/[C@@H]1C]

In some embodiments, the splicing modulator comprises D27:
(D27)
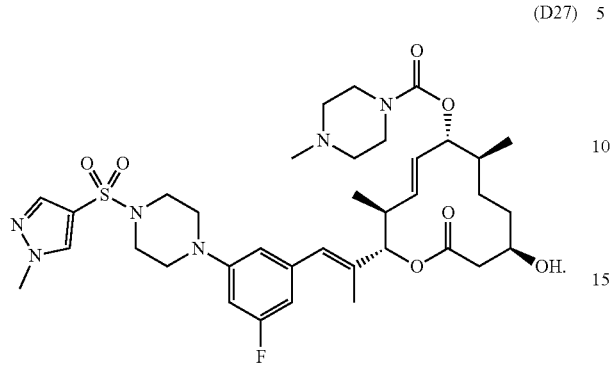
In some embodiments, the splicing modulator comprises D28:
(D28)
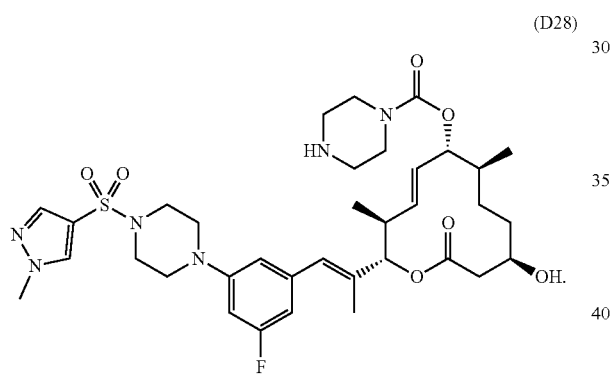
In some embodiments, the splicing modulator comprises D29:
(D29)
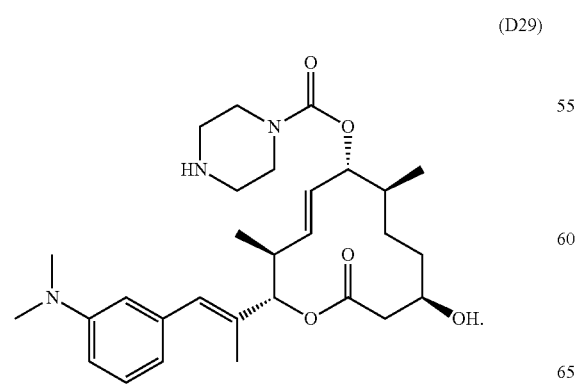
In some embodiments, the splicing modulator comprises D30:
(D30)
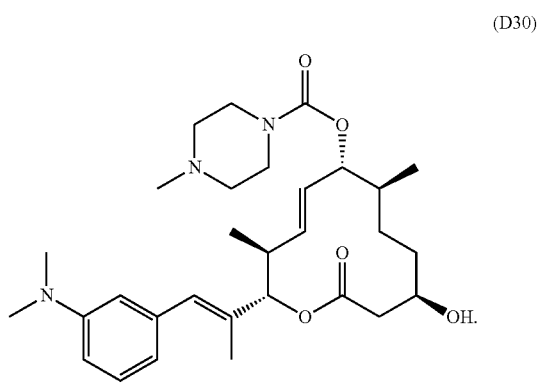 [SMILES: C/C(=C\c1cccc(N(C)C)c1)[C@H]1OC(=O)C[C@H](O)CC[C@H](C)[C@@H](OC(=O)N2CCN(C)CC2)/C=C/[C@@H]1C]
In some embodiments, the splicing modulator comprises D31:
(D31)
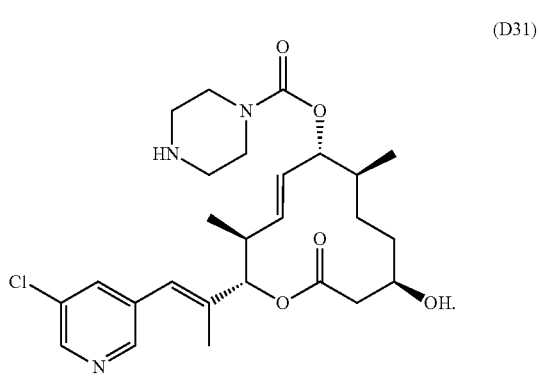 [SMILES: C/C(=C\c1cncc(Cl)c1)[C@H]1OC(=O)C[C@H](O)CC[C@H](C)[C@@H](OC(=O)N2CCNCC2)/C=C/[C@@H]1C]
In some embodiments, the splicing modulator comprises D32:
(D32)
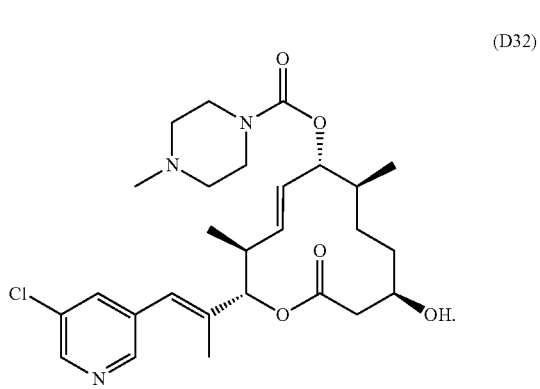 [SMILES: C/C(=C\c1cncc(Cl)c1)[C@H]1OC(=O)C[C@H](O)CC[C@H](C)[C@@H](OC(=O)N2CCN(C)CC2)/C=C/[C@@H]1C]

In some embodiments, the splicing modulator comprises D33:

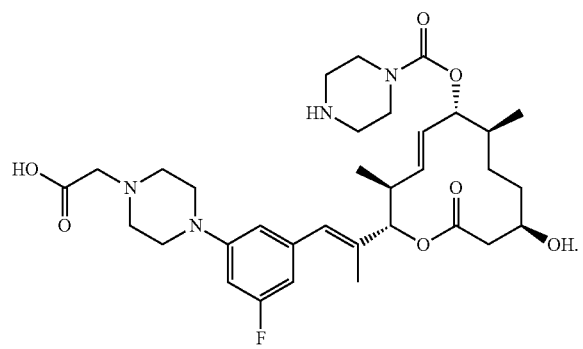

(D33)

In some embodiments, the splicing modulator comprises D34:

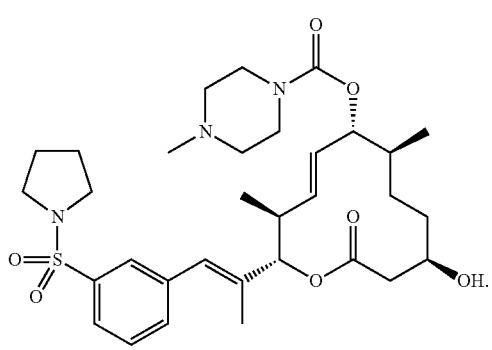

(D34)

In some embodiments, the splicing modulator comprises D35:

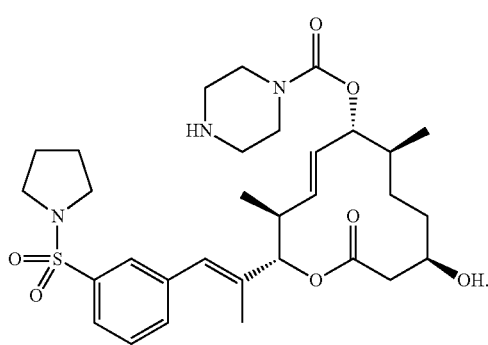

(D35)

An exemplary ADC has Formula (I):

Ab-(L-D)$_p$     (I)

wherein
Ab is an antibody or antigen-binding fragment capable of binding to BCMA;
D is D1 or D2;
L is a linker which covalently attaches Ab to D; and
p is an integer from 1 to 15.

In some embodiments, the antibody or antigen-binding fragment of the ADC targets a cell expressing BCMA. In some embodiments, the antibody or antigen-binding fragment of the ADC is an internalizing antibody or internalizing antigen-binding fragment.

In some embodiments, the ADC has Formula (I):

Ab-(L-D)$_p$     (I)

wherein
Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 2 (HCDR2), and SEQ ID NO: 3 (HCDR3); and three LCDRs comprising amino acid sequences of SEQ ID NO: 4 (LCDR1), SEQ ID NO: 5 (LCDR2), and SEQ ID NO: 6 (LCDR3), as defined by the Kabat numbering system; or three HCDRs comprising amino acid sequences of SEQ ID NO: 37 (HCDR1), SEQ ID NO: 38 (HCDR2), and SEQ ID NO: 39 (HCDR3); and three LCDRs comprising amino acid sequences of SEQ ID NO: 40 (LCDR1), SEQ ID NO: 41 (LCDR2), and SEQ ID NO: 42 (LCDR3), as defined by the IMGT numbering system;
D is D1 or D2;
L is a linker which covalently attaches Ab to D; and
p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 76, and a light chain variable region comprising an amino acid sequence of SEQ ID NO: 77. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region. In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 92, and a light chain comprising an amino acid sequence of SEQ ID NO: 93. In some embodiments, the heavy chain constant region or heavy chain further comprises a C-terminal lysine (K). In some embodiments, the antibody or antigen-binding fragment of the ADC is AB212.

In some embodiments, D is D1. In some embodiments, D is D2.

In some embodiments, L is selected from any of the linkers disclosed herein, or any combination of linker components disclosed herein. In some embodiments, L is an ADL1, ADL2, ADL5, ADL6, ADL7, ADL10, ADL12, ADL13, ADL14, ADL15, ADL21, ADL22, or ADL23 linker. In some embodiments, the ADL1, ADL2, ADL5, ADL6, ADL7, ADL10, ADL12, ADL13, ADL14, ADL15, ADL21, ADL22, or ADL23 linker may also comprise one or more additional spacer units. In some embodiments, L is an ADL1, ADL6, ADL13, ADL21, ADL22, or ADL23 linker. In some embodiments, the ADL1, ADL6, ADL13, ADL21, ADL22, or ADL23 linker may also comprise one or more additional spacer units.

In some embodiments, L is a cleavable linker. In some embodiments, the cleavable linker comprises MC-Val-Cit-pABC, MC-Val-Ala-pABC, MC-Ala-Ala-Asp-pABC, MC-Glu-Val-Cit-pABC, MC-(PEG)$_2$-Val-Cit-pABC, or MC-β-glucuronide. In some embodiments, the cleavable linker may also comprise one or more additional spacer units. In some embodiments, L is a non-cleavable linker.

In some embodiments, p is from 1 to 12. In some embodiments, p is from 2 to 8. In some embodiments, p is from 4 to 8. In some embodiments, p is 4. In some embodiments, p is 8.

In some embodiments, the ADC has Formula (I):

$$\text{Ab-(L-D)}_p \quad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 7 (HCDR2), and SEQ ID NO: 8 (HCDR3); and three LCDRs comprising amino acid sequences of SEQ ID NO: 9 (LCDR1), SEQ ID NO: 10 (LCDR2), and SEQ ID NO: 11 (LCDR3), as defined by the Kabat numbering system; or three HCDRs comprising amino acid sequences of SEQ ID NO: 43 (HCDR1), SEQ ID NO: 44 (HCDR2), and SEQ ID NO: 45 (HCDR3); and three LCDRs comprising amino acid sequences of SEQ ID NO: 40 (LCDR1), SEQ ID NO: 41 (LCDR2), and SEQ ID NO: 46 (LCDR3), as defined by the IMGT numbering system;

D is D1 or D2;

L is a linker which covalently attaches Ab to D; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 78, and a light chain variable region comprising an amino acid sequence of SEQ ID NO: 79. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region. In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 94, and a light chain comprising an amino acid sequence of SEQ ID NO: 95. In some embodiments, the heavy chain constant region or heavy chain further comprises a C-terminal lysine (K). In some embodiments, the antibody or antigen-binding fragment of the ADC is AB213.

In some embodiments, D is D1. In some embodiments, D is D2.

In some embodiments, L is selected from any of the linkers disclosed herein, or any combination of linker components disclosed herein. In some embodiments, L is an ADL1, ADL2, ADL5, ADL6, ADL7, ADL10, ADL12, ADL13, ADL14, ADL15, ADL21, ADL22, or ADL23 linker. In some embodiments, the ADL1, ADL2, ADL5, ADL6, ADL7, ADL10, ADL12, ADL13, ADL14, ADL15, ADL21, ADL22, or ADL23 linker may also comprise one or more additional spacer units. In some embodiments, L is an ADL1, ADL6, ADL13, ADL21, ADL22, or ADL23 linker. In some embodiments, the ADL1, ADL6, ADL13, ADL21, ADL22, or ADL23 linker may also comprise one or more additional spacer units.

In some embodiments, L is a cleavable linker. In some embodiments, the cleavable linker comprises MC-Val-Cit-pABC, MC-Val-Ala-pABC, MC-Ala-Ala-Asp-pABC, MC-Glu-Val-Cit-pABC, MC-(PEG)$_2$-Val-Cit-pABC, or MC-β-glucuronide. In some embodiments, the cleavable linker may also comprise one or more additional spacer units. In some embodiments, L is a non-cleavable linker.

In some embodiments, p is from 1 to 12. In some embodiments, p is from 2 to 8. In some embodiments, p is from 4 to 8. In some embodiments, p is 4. In some embodiments, p is 8.

In some embodiments, the ADC has Formula (I):

$$\text{Ab-(L-D)}_p \quad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 12 (HCDR2), and SEQ ID NO: 13 (HCDR3); and three LCDRs comprising amino acid sequences of SEQ ID NO: 14 (LCDR1), SEQ ID NO: 15 (LCDR2), and SEQ ID NO: 16 (LCDR3), as defined by the Kabat numbering system; or three HCDRs comprising amino acid sequences of SEQ ID NO: 47 (HCDR1), SEQ ID NO: 48 (HCDR2), and SEQ ID NO: 49 (HCDR3); and three LCDRs comprising amino acid sequences of SEQ ID NO: 40 (LCDR1), SEQ ID NO: 41 (LCDR2), and SEQ ID NO: 50 (LCDR3), as defined by the IMGT numbering system;

D is D1 or D2;

L is a linker which covalently attaches Ab to D; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 80, and a light chain variable region comprising an amino acid sequence of SEQ ID NO: 81. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region.

In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 96, and a light chain comprising an amino acid sequence of SEQ ID NO: 97. In some embodiments, the heavy chain constant region or heavy chain further comprises a C-terminal lysine (K). In some embodiments, the antibody or antigen-binding fragment of the ADC is AB214.

In some embodiments, D is D1. In some embodiments, D is D2.

In some embodiments, L is selected from any of the linkers disclosed herein, or any combination of linker components disclosed herein. In some embodiments, L is an ADL1, ADL2, ADL5, ADL6, ADL7, ADL10, ADL12, ADL13, ADL14, ADL15, ADL21, ADL22, or ADL23 linker. In some embodiments, the ADL1, ADL2, ADL5, ADL6, ADL7, ADL10, ADL12, ADL13, ADL14, ADL15, ADL21, ADL22, or ADL23 linker may also comprise one or more additional spacer units. In some embodiments, L is an ADL1, ADL6, ADL13, ADL21, ADL22, or ADL23 linker. In some embodiments, the ADL1, ADL6, ADL13, ADL21, ADL22, or ADL23 linker may also comprise one or more additional spacer units.

In some embodiments, L is a cleavable linker. In some embodiments, the cleavable linker comprises MC-Val-Cit-pABC, MC-Val-Ala-pABC, MC-Ala-Ala-Asp-pABC, MC-Glu-Val-Cit-pABC, MC-(PEG)$_2$-Val-Cit-pABC, or MC-β-glucuronide. In some embodiments, the cleavable linker may also comprise one or more additional spacer units. In some embodiments, L is a non-cleavable linker.

In some embodiments, p is from 1 to 12. In some embodiments, p is from 2 to 8. In some embodiments, p is from 4 to 8. In some embodiments, p is 4. In some embodiments, p is 8.

In some embodiments, the ADC has Formula (I):

$$Ab-(L-D)_p \qquad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 17 (HCDR2), and SEQ ID NO: 18 (HCDR3); and three LCDRs comprising amino acid sequences of SEQ ID NO: 19 (LCDR1), SEQ ID NO: 20 (LCDR2), and SEQ ID NO: 21 (LCDR3), as defined by the Kabat numbering system; or three HCDRs comprising amino acid sequences of SEQ ID NO: 51 (HCDR1), SEQ ID NO: 52 (HCDR2), and SEQ ID NO: 53 (HCDR3); and three LCDRs comprising amino acid sequences of SEQ ID NO: 40 (LCDR1), SEQ ID NO: 41 (LCDR2), and SEQ ID NO: 54 (LCDR3), as defined by the IMGT numbering system;

D is D1 or D2;

L is a linker which covalently attaches Ab to D; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 82, and a light chain variable region comprising an amino acid sequence of SEQ ID NO: 83. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region. In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 98, and a light chain comprising an amino acid sequence of SEQ ID NO: 99. In some embodiments, the heavy chain constant region or heavy chain further comprises a C-terminal lysine (K). In some embodiments, the antibody or antigen-binding fragment of the ADC is AB215.

In some embodiments, D is D1. In some embodiments, D is D2.

In some embodiments, L is selected from any of the linkers disclosed herein, or any combination of linker components disclosed herein. In some embodiments, L is an ADL1, ADL2, ADL5, ADL6, ADL7, ADL10, ADL12, ADL13, ADL14, ADL15, ADL21, ADL22, or ADL23 linker. In some embodiments, the ADL1, ADL2, ADL5, ADL6, ADL7, ADL10, ADL12, ADL13, ADL14, ADL15, ADL21, ADL22, or ADL23 linker may also comprise one or more additional spacer units. In some embodiments, L is an ADL1, ADL6, ADL13, ADL21, ADL22, or ADL23 linker. In some embodiments, the ADL1, ADL6, ADL13, ADL21, ADL22, or ADL23 linker may also comprise one or more additional spacer units.

In some embodiments, L is a cleavable linker. In some embodiments, the cleavable linker comprises MC-Val-Cit-pABC, MC-Val-Ala-pABC, MC-Ala-Ala-Asp-pABC, MC-Glu-Val-Cit-pABC, MC-(PEG)$_2$-Val-Cit-pABC, or MC-β-glucuronide. In some embodiments, the cleavable linker may also comprise one or more additional spacer units. In some embodiments, L is a non-cleavable linker.

In some embodiments, p is from 1 to 12. In some embodiments, p is from 2 to 8. In some embodiments, p is from 4 to 8. In some embodiments, p is 4. In some embodiments, p is 8.

In some embodiments, the ADC has Formula (I):

$$Ab-(L-D)_p \qquad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system;

D is D1 or D2;

L is a linker which covalently attaches Ab to D; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 84, and a light chain variable region comprising an amino acid sequence of SEQ ID NO: 85. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region. In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 100, and a light chain comprising an amino acid sequence of SEQ ID NO: 101. In some embodiments, the heavy chain constant region or heavy chain further comprises a C-terminal lysine (K). In some embodiments, the antibody or antigen-binding fragment of the ADC is AB216.

In some embodiments, D is D1. In some embodiments, D is D2.

In some embodiments, L is selected from any of the linkers disclosed herein, or any combination of linker components disclosed herein. In some embodiments, L is an ADL1, ADL2, ADL5, ADL6, ADL7, ADL10, ADL12, ADL13, ADL14, ADL15, ADL21, ADL22, or ADL23 linker. In some embodiments, the ADL1, ADL2, ADL5, ADL6, ADL7, ADL10, ADL12, ADL13, ADL14, ADL15, ADL21, ADL22, or ADL23 linker may also comprise one or more additional spacer units. In some embodiments, L is an ADL1, ADL6, ADL13, ADL21, ADL22, or ADL23 linker. In some embodiments, the ADL1, ADL6, ADL13, ADL21, ADL22, or ADL23 linker may also comprise one or more additional spacer units.

In some embodiments, L is a cleavable linker. In some embodiments, the cleavable linker comprises MC-Val-Cit-pABC, MC-Val-Ala-pABC, MC-Ala-Ala-Asp-pABC, MC-Glu-Val-Cit-pABC, MC-(PEG)₂-Val-Cit-pABC, or MC-β- glucuronide. In some embodiments, the cleavable linker may also comprise one or more additional spacer units. In some embodiments, L is a non-cleavable linker.

In some embodiments, p is from 1 to 12. In some embodiments, p is from 2 to 8. In some embodiments, p is from 4 to 8. In some embodiments, p is 4. In some embodiments, p is 8.

In some embodiments, the ADC has Formula (I):

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system;

D is D1;

L is a linker comprising MC-Val-Cit-pABC (ADL1); and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 84, and a light chain variable region comprising an amino acid sequence of SEQ ID NO: 85. In some embodiments, the antibody or antigen-binding fragment of the ADC comprises a human IgG1 heavy chain constant region, and a human Ig kappa light chain constant region. In some embodiments, the antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 100, and a light chain comprising an amino acid sequence of SEQ ID NO: 101. In some embodiments, the heavy chain constant region or heavy chain further comprises a C-terminal lysine (K). In some embodiments, p is from 1 to 12. In some embodiments, p is from 2 to 8. In some embodiments, p is from 4 to 8. In some embodiments, p is 4. In some embodiments, p is 8.

In some embodiments, the ADC has Formula (I):

wherein

Ab is an antibody or antigen-binding fragment, wherein the antibody or antigen-binding fragment is capable of binding to BCMA and comprises a heavy chain variable region comprising an amino acid sequence of SEQ ID NO: 84, and a light chain variable region comprising an amino acid sequence of SEQ ID NO: 85;

D is D1;

L is a linker comprising MC-Val-Cit-pABC (ADL1); and p is an integer from 1 to 15.

In some embodiments, the antibody or antigen-binding fragment of the ADC comprises a human IgG1 heavy chain constant region, and a human Ig kappa light chain constant region. In some embodiments, the antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 100, and a light chain comprising an amino acid sequence of SEQ ID NO: 101. In some embodiments, the heavy chain constant region or heavy chain further comprises a C-terminal lysine (K). In some embodiments, p is from 1 to 12. In some embodiments, p is from 2 to 8. In some embodiments, p is from 4 to 8. In some embodiments, p is 4. In some embodiments, p is 8.

In some embodiments, the ADC has Formula (I):

$$\text{Ab-(L-D)}_p \quad\quad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 27 (HCDR2), and SEQ ID NO: 28 (HCDR3); and three LCDRs comprising amino acid sequences of SEQ ID NO: 29 (LCDR1), SEQ ID NO: 30 (LCDR2), and SEQ ID NO: 31 (LCDR3), as defined by the Kabat numbering system; or three HCDRs comprising amino acid sequences of SEQ ID NO: 59 (HCDR1), SEQ ID NO: 60 (HCDR2), and SEQ ID NO: 61 (HCDR3); and three LCDRs comprising amino acid sequences of SEQ ID NO: 40 (LCDR1), SEQ ID NO: 41 (LCDR2), and SEQ ID NO: 62 (LCDR3), as defined by the IMGT numbering system;

D is D1 or D2;

L is a linker which covalently attaches Ab to D; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 86, and a light chain variable region comprising an amino acid sequence of SEQ ID NO: 87. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region. In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 102, and a light chain comprising an amino acid sequence of SEQ ID NO: 103. In some embodiments, the heavy chain constant region or heavy chain further comprises a C-terminal lysine (K). In some embodiments, the antibody or antigen-binding fragment of the ADC is AB217.

In some embodiments, D is D1. In some embodiments, D is D2.

In some embodiments, L is selected from any of the linkers disclosed herein, or any combination of linker components disclosed herein. In some embodiments, L is an ADL1, ADL2, ADL5, ADL6, ADL7, ADL10, ADL12, ADL13, ADL14, ADL15, ADL21, ADL22, or ADL23 linker. In some embodiments, the ADL1, ADL2, ADL5, ADL6, ADL7, ADL10, ADL12, ADL13, ADL14, ADL15, ADL21, ADL22, or ADL23 linker may also comprise one or more additional spacer units. In some embodiments, L is an ADL1, ADL6, ADL13, ADL21, ADL22, or ADL23 linker. In some embodiments, the ADL1, ADL6, ADL13, ADL21, ADL22, or ADL23 linker may also comprise one or more additional spacer units.

In some embodiments, L is a cleavable linker. In some embodiments, the cleavable linker comprises MC-Val-Cit-pABC, MC-Val-Ala-pABC, MC-Ala-Ala-Asp-pABC, MC-Glu-Val-Cit-pABC, MC-(PEG)$_2$-Val-Cit-pABC, or MC-β-glucuronide. In some embodiments, the cleavable linker may also comprise one or more additional spacer units. In some embodiments, L is a non-cleavable linker.

In some embodiments, p is from 1 to 12. In some embodiments, p is from 2 to 8. In some embodiments, p is from 4 to 8. In some embodiments, p is 4. In some embodiments, p is 8.

In some embodiments, the ADC has Formula (I):

$$\text{Ab-(L-D)}_p \quad\quad (I)$$

wherein

Ab is an antibody or antigen-binding fragment, wherein the antibody or antigen-binding fragment is capable of binding to BCMA and comprises three HCDRs comprising amino acid sequences of SEQ ID NO: 1 (HCDR1), SEQ ID NO: 32 (HCDR2), and SEQ ID NO: 33 (HCDR3); and three LCDRs comprising amino acid sequences of SEQ ID NO: 34 (LCDR1), SEQ ID NO: 35 (LCDR2), and SEQ ID NO: 36 (LCDR3), as defined by the Kabat numbering system; or three HCDRs comprising amino acid sequences of SEQ ID NO: 63 (HCDR1), SEQ ID NO: 64 (HCDR2), and SEQ ID NO: 65 (HCDR3); and three LCDRs comprising amino acid sequences of SEQ ID NO: 40 (LCDR1), SEQ ID NO: 41 (LCDR2), and SEQ ID NO: 66 (LCDR3), as defined by the IMGT numbering system;

D is D1 or D2;

L is a linker which covalently attaches Ab to D; and p is an integer from 1 to 15.

In some embodiments, the antibody or antigen-binding fragment of the ADC comprises human heavy and light chain variable region frameworks, or human heavy and light chain variable region frameworks with one or more back mutations. In some embodiments, the antibody or antigen-binding fragment of the ADC comprises a heavy chain variable region comprising an amino acid sequence of SEQ ID NO: 88, and a light chain variable region comprising an amino acid sequence of SEQ ID NO: 89. In some embodiments, the antibody or antigen-binding fragment of the ADC comprises a human IgG1 heavy chain constant region and a human Ig kappa light chain constant region. In some embodiments, the antibody or antigen-binding fragment of the ADC comprises a human IgG1 heavy chain constant region and a human Ig lambda light chain constant region.

In some embodiments, the antibody or antigen-binding fragment of the ADC comprises a human IgG4 heavy chain constant region and a human Ig kappa light chain constant region. In some embodiments, the antibody or antigen-binding fragment of the ADC comprises a human IgG4 heavy chain constant region and a human Ig lambda light chain constant region. In some embodiments, an antibody or antigen-binding fragment of the ADC comprises a heavy chain constant region comprising an amino acid sequence of SEQ ID NO: 90, and a light chain constant region comprising an amino acid sequence of SEQ ID NO: 91. In some embodiments, the antibody or antigen-binding fragment of the ADC comprises a heavy chain comprising an amino acid sequence of SEQ ID NO: 104, and a light chain comprising an amino acid sequence of SEQ ID NO: 105. In some embodiments, the heavy chain constant region or heavy chain further comprises a C-terminal lysine (K). In some embodiments, the antibody or antigen-binding fragment of the ADC is AB218.

In some embodiments, D is D1. In some embodiments, D is D2.

In some embodiments, L is selected from any of the linkers disclosed herein, or any combination of linker components disclosed herein. In some embodiments, L is an ADL1, ADL2, ADL5, ADL6, ADL7, ADL10, ADL12, ADL13, ADL14, ADL15, ADL21, ADL22, or ADL23 linker. In some embodiments, the ADL1, ADL2, ADL5, ADL6, ADL7, ADL10, ADL12, ADL13, ADL14, ADL15, ADL21, ADL22, or ADL23 linker may also comprise one or more additional spacer units. In some embodiments, L is an ADL1, ADL6, ADL13, ADL21, ADL22, or ADL23 linker. In some embodiments, the ADL1, ADL6, ADL13, ADL21, ADL22, or ADL23 linker may also comprise one or more additional spacer units.

In some embodiments, L is a cleavable linker. In some embodiments, the cleavable linker comprises MC-Val-Cit-pABC, MC-Val-Ala-pABC, MC-Ala-Ala-Asp-pABC, MC-Glu-Val-Cit-pABC, MC-(PEG)$_2$-Val-Cit-pABC, or MC-β-glucuronide. In some embodiments, the cleavable linker may also comprise one or more additional spacer units. In some embodiments, L is a non-cleavable linker.

In some embodiments, p is from 1 to 12. In some embodiments, p is from 2 to 8. In some embodiments, p is from 4 to 8. In some embodiments, p is 4. In some embodiments, p is 8.

In some embodiments, an ADC comprising a D1 or D2 drug moiety as disclosed herein demonstrates improved drug loading (drug-to-antibody ratio), lower aggregation levels, increased stability, increased on-target killing of cancer cells, decreased off-target killing of non-cancer cells, and/or increased cytotoxicity and/or potency relative to an ADC comprising an alternate drug moiety (e.g., an alternate splicing modulator drug moiety). In some embodiments, an ADC comprising a D1 or D2 drug moiety as disclosed herein provides good or superior properties in one or more of the categories listed above, or across a spectrum of functional properties for a therapeutic ADC. In some embodiments, an ADC comprising a D1 or D2 drug moiety exhibits surprisingly effective potency and increased inhibition of cell growth and/or proliferation in cells that express the antigen targeted by the ADC, as compared to an ADC comprising an alternate drug moiety (e.g., an alternate splicing modulator drug moiety).

Drug Loading

Drug loading is represented by p and is also referred to herein as the drug-to-antibody ratio (DAR). Drug loading may range from 1 to 15 drug moieties per antibody or antigen-binding fragment. In some embodiments, p is an integer from 1 to 15. In some embodiments, p is an integer from 1 to 12. In some embodiments, p is an integer from 1 to 10. In some embodiments, p is an integer from 1 to 10, 1 to 9, 1 to 8, 1 to 7, 1 to 6, 1 to 5, 1 to 4, 1 to 3, or 1 to 2. In some embodiments, p is an integer from 2 to 10, 2 to 9, 2 to 8, 2 to 7, 2 to 6, 2 to 5, 2 to 4, or 2 to 3. In some embodiments, p is an integer from 1 to 8. In some embodiments, p is an integer from 1 to 5. In some embodiments, p is an integer from 2 to 6. In some embodiments, p is an integer from 2 to 4. In some embodiments, p is 3 or 4. In other embodiments, p is an integer from 4 to 8. In other embodiments, p is 1, 2, 3, 4, 5, 6, 7, or 8, e.g., 4 or 8. In some embodiments, p is 4. In some embodiments, p is 8.

Drug loading may be limited by the number of attachment sites on the antibody or antigen-binding fragment. In some embodiments, the linker moiety (L) of the ADC attaches to the antibody or antigen-binding fragment through a chemically active group on one or more amino acid residues on the antibody or antigen-binding fragment. For example, the linker may be attached to the antibody or antigen-binding fragment via a free amino, imino, hydroxyl, thiol, or carboxyl group (e.g., to the N- or C-terminus, to the epsilon amino group of one or more lysine residues, to the free carboxylic acid group of one or more glutamic acid or aspartic acid residues, or to the sulfhydryl group of one or more cysteine residues). The site to which the linker is attached can be a natural residue in the amino acid sequence of the antibody or antigen-binding fragment, or it can be introduced into the antibody or antigen-binding fragment, e.g., by DNA recombinant technology (e.g., by introducing a cysteine residue into the amino acid sequence) or by protein biochemistry (e.g., by reduction, pH adjustment, or hydrolysis).

In some embodiments, the number of drug moieties that can be conjugated to an antibody or antigen-binding fragment is limited by the number of free cysteine residues. For example, where the attachment is a cysteine thiol group, an antibody may have only one or a few cysteine thiol groups, or may have only one or a few sufficiently reactive thiol groups through which a linker may be attached. Generally, antibodies do not contain many free and reactive cysteine thiol groups that may be linked to a drug moiety. Indeed, most cysteine thiol residues in antibodies are involved in either interchain or intrachain disulfide bonds. Conjugation to cysteines can therefore, in some embodiments, require at least partial reduction of the antibody. Over-attachment of linker-drug to an antibody may destabilize the antibody by reducing the cysteine residues available to form disulfide bonds. Therefore, an optimal drug-to-antibody ratio should increase potency of the ADC (by increasing the number of attached drug moieties per antibody) without destabilizing the antibody or antigen-binding fragment. In some embodiments, an optimal ratio may be 2, 3, 4, 5, 6, 7, or 8. In some embodiments, an optimal ratio may be about 4. In some embodiments, an optimal ratio may be about 8.

In some embodiments, an antibody or antigen-binding fragment is exposed to reducing conditions prior to conjugation in order to generate one or more free cysteine residues. An antibody, in some embodiments, may be reduced with a reducing agent such as dithiothreitol (DTT) or tris(2-carboxyethyl)phosphine (TCEP), under partial or total reducing conditions, to generate reactive cysteine thiol groups. Unpaired cysteines may be generated through partial reduction with limited molar equivalents of TCEP, which can reduce the interchain disulfide bonds which link the light chain and heavy chain (one pair per H-L pairing) and the two heavy chains in the hinge region (two pairs per H-H pairing in the case of human IgG1) while leaving the intrachain disulfide bonds intact (Stefano et al. (2013) Methods Mol Biol. 1045:145-71). In embodiments, disulfide bonds within the antibodies are reduced electrochemically, e.g., by employing a working electrode that applies an alternating reducing and oxidizing voltage. This approach can allow for on-line coupling of disulfide bond reduction to an analytical device (e.g., an electrochemical detection device, an NMR spectrometer, or a mass spectrometer) or a chemical separation device (e.g., a liquid chromatograph (e.g., an HPLC) or an electrophoresis device (see, e.g., U.S. Publ. No. 20140069822)). In some embodiments, an antibody is subjected to denaturing conditions to reveal reactive nucleophilic groups on amino acid residues, such as cysteine.

The drug loading of an ADC may be controlled in different ways, e.g., by: (i) limiting the molar excess of drug-linker intermediate or linker reagent relative to antibody; (ii) limiting the conjugation reaction time or temperature; (iii) partial or limiting reductive conditions for cysteine thiol modification; and/or (iv) engineering by recombinant techniques the amino acid sequence of the antibody such that the number and position of cysteine residues is modified for control of the number and/or position of linker-drug attachments.

In some embodiments, free cysteine residues are introduced into the amino acid sequence of the antibody or antigen-binding fragment. For example, cysteine engineered antibodies can be prepared wherein one or more amino acids of a parent antibody are replaced with a cysteine amino acid. Any form of antibody may be so engineered, i.e., mutated. For example, a parent Fab antibody fragment may be engineered to form a cysteine engineered Fab referred to as a "ThioFab." Similarly, a parent monoclonal antibody may be engineered to form a "ThioMab." A single site mutation yields a single engineered cysteine residue in a ThioFab, whereas a single site mutation yields two engineered cysteine residues in a ThioMab, due to the dimeric nature of the IgG antibody. DNA encoding an amino acid sequence variant of the parent polypeptide can be prepared by a variety of methods known in the art (see, e.g., the methods described in Intl. Pub. No. WO 2006/034488). These methods include, but are not limited to, preparation by site-directed (or oligonucleotide-mediated) mutagenesis, PCR mutagenesis, and cassette mutagenesis of an earlier prepared DNA encoding the polypeptide. Variants of recombinant antibodies may also be constructed by restriction fragment manipulation or by overlap extension PCR with synthetic oligonucleotides. ADCs of Formula (I) include, but are not limited to, antibodies that have 1, 2, 3, or 4 engineered cysteine amino acids (Lyon et al. (2012) Methods Enzymol. 502:123-38). In some embodiments, one or more free cysteine residues are already present in an antibody or antigen-binding fragment, without the use of engineering, in which case the existing free cysteine residues may be used to conjugate the antibody or antigen-binding fragment to a drug moiety.

In some embodiments, one or more site-specific conjugation technologies are used to produce a homogeneous ADC product with a defined drug loading, i.e., a defined p or drug-to-antibody ratio (DAR). In some embodiments, free cysteine residues can be generated in the light chain or heavy chain of antibodies for site-specific conjugation via Residue-SPEcific Conjugation Technology (RESPECT). Exemplary protocols for the generation of RESPECT-formatted antibodies are described in Albone et al. (2017) Cancer Biol. Ther. 18(5):347-357, and in Intl. Pub. Nos. WO/2016205618 and WO/2017106643, each of which is incorporated herein by reference for methods of performing site-specific conjugation. In some embodiments, an ADC disclosed herein is produced using site-specific conjugation to covalently attach an antibody moiety to a drug moiety via a linker.

Where more than one nucleophilic group reacts with a drug-linker intermediate or a linker moiety reagent followed by drug moiety reagent, in a reaction mixture comprising multiple copies of the antibody or antigen-binding fragment and linker moiety, then the resulting product can be a mixture of ADCs with a distribution of one or more drug moieties attached to each copy of the antibody or antigen-binding fragment in the mixture. In some embodiments, the drug loading in a mixture of ADCs resulting from a conjugation reaction ranges from 1 to 10 drug moieties attached per antibody or antigen-binding fragment. The average number of drug moieties per antibody or antigen-binding fragment (i.e., the average drug loading, or average p) may be calculated by any conventional method known in the art, e.g., by mass spectrometry (e.g., reverse-phase LC-MS), and/or high-performance liquid chromatography (e.g., hydrophobic interaction chromatography-high performance liquid chromatography (HIC-HPLC)). In some embodiments, the average number of drug moieties per antibody or antigen-binding fragment is determined by HIC-HPLC. In some embodiments, the average number of drug moieties per antibody or antigen-binding fragment is determined by reverse-phase liquid chromatography-mass spectrometry (LC-MS). In some embodiments, the average number of drug moieties per antibody or antigen-binding fragment is from about 1.5 to about 3.5, about 2.5 to about 4.5, about 3.5 to about 5.5, about 4.5 to about 6.5, about 5.5 to about 7.5, about 6.5 to about 8.5, or about 7.5 to about 9.5. In some embodiments, the average number of drug moieties per antibody or antigen-binding fragment is from about 2 to about 6, about 2 to about 4, about 3 to about 5, about 4 to about 6, about 5 to about 7, about 6 to about 8, about 7 to about 9, about 2 to about 8, about 2 to about 10, about 4 to about 8, or about 4 to about 10. In some embodiments, the average number of drug moieties per antibody or antigen-binding fragment is from about 2 to about 8. In some embodiments, the average number of drug moieties per antibody or antigen-binding fragment is from about 2 to about 6. In some embodiments, the average number of drug moieties per antibody or antigen-binding fragment is about 4. In some embodiments, the average number of drug moieties per antibody or antigen-binding fragment is about 8.

In some embodiments, the average number of drug moieties per antibody or antigen-binding fragment is about 2. In some embodiments, the average number of drug moieties per antibody or antigen-binding fragment is about 1.5, about 1.6, about 1.7, about 1.8, about 1.9, about 2, about 2.1, about 2.2, about 2.3, about 2.4, or about 2.5. In some embodiments, the average number of drug moieties per antibody or antigen-binding fragment is 2.

In some embodiments, the average number of drug moieties per antibody or antigen-binding fragment is about 3. In some embodiments, the average number of drug moieties per antibody or antigen-binding fragment is about 2.5, about 2.6, about 2.7, about 2.8, about 2.9, about 3, about 3.1, about 3.2, about 3.3, about 3.4, or about 3.5. In some embodiments, the average number of drug moieties per antibody or antigen-binding fragment is 3.

In some embodiments, the average number of drug moieties per antibody or antigen-binding fragment is about 4. In some embodiments, the average number of drug moieties per antibody or antigen-binding fragment is about 3.5, about 3.6, about 3.7, about 3.8, about 3.9, about 4, about 4.1, about 4.2, about 4.3, about 4.4, or about 4.5. In some embodiments, the average number of drug moieties per antibody or antigen-binding fragment is 4.

In some embodiments, the average number of drug moieties per antibody or antigen-binding fragment is about 5. In some embodiments, the average number of drug moieties per antibody or antigen-binding fragment is about 4.5, about 4.6, about 4.7, about 4.8, about 4.9, about 5, about 5.1, about 5.2, about 5.3, about 5.4, or about 5.5. In some embodiments, the average number of drug moieties per antibody or antigen-binding fragment is 5.

In some embodiments, the average number of drug moieties per antibody or antigen-binding fragment is about 6. In some embodiments, the average number of drug moieties per antibody or antigen-binding fragment is about 5.5, about 5.6, about 5.7, about 5.8, about 5.9, about 6, about 6.1, about 6.2, about 6.3, about 6.4, or about 6.5. In some embodiments, the average number of drug moieties per antibody or antigen-binding fragment is 6.

In some embodiments, the average number of drug moieties per antibody or antigen-binding fragment is about 7. In some embodiments, the average number of drug moieties per antibody or antigen-binding fragment is about 6.5, about 6.6, about 6.7, about 6.8, about 6.9, about 7, about 7.1, about 7.2, about 7.3, about 7.4, or about 7.5. In some embodiments, the average number of drug moieties per antibody or antigen-binding fragment is 7.

In some embodiments, the average number of drug moieties per antibody or antigen-binding fragment is about 8. In some embodiments, the average number of drug moieties per antibody or antigen-binding fragment is about 7.5, about 7.6, about 7.7, about 7.8, about 7.9, about 8, about 8.1, about 8.2, about 8.3, about 8.4, or about 8.5. In some embodiments, the average number of drug moieties per antibody or antigen-binding fragment is 8.

In various embodiments, the term "about," as used with respect to the average number of drug moieties per antibody or antigen-binding fragment, means plus or minus 10%.

Individual ADC compounds, or "species," may be identified in the mixture by mass spectroscopy and separated by UPLC or HPLC, e.g. hydrophobic interaction chromatography (HIC-HPLC). In some embodiments, a homogeneous or nearly homogenous ADC product with a single loading value may be isolated from the conjugation mixture, e.g., by chromatography.

In some embodiments, higher drug loading (e.g., p>10) may cause aggregation, insolubility, toxicity, or loss of cellular permeability of certain ADCs. Higher drug loading may also negatively affect the pharmacokinetics (e.g., clearance) of certain ADCs. In some embodiments, lower drug loading (e.g., p<2) may reduce the potency of certain ADCs against target antigen-expressing cells and/or bystander cells. In some embodiments, the drug loading for an ADC of the present disclosure ranges from about 2 to about 10; from about 2 to about 8; from about 2 to about 6; from about 2 to about 5; from about 3 to about 5; from about 2 to about 4; from about 4 to about 8; or from about 4 to about 10.

In some embodiments, a drug loading and/or an average drug loading of about 2 is achieved, e.g., using partial reduction of intrachain disulfides on the antibody or antigen-binding fragment, and provides beneficial properties. In some embodiments, a drug loading and/or an average drug loading of about 4 is achieved, e.g., using partial reduction of intrachain disulfides on the antibody or antigen-binding fragment, and provides beneficial properties. In some embodiments, a drug loading and/or an average drug loading of about 8 is achieved, e.g., using partial reduction of intrachain disulfides on the antibody or antigen-binding fragment, and provides beneficial properties. In some embodiments, a drug loading and/or an average drug loading of less than about 2 may result in an unacceptably high level of unconjugated antibody species, which can compete with the ADC for binding to a target antigen and/or provide for reduced treatment efficacy. In some embodiments, a drug loading and/or average drug loading of more than about 8 may result in an unacceptably high level of product heterogeneity and/or ADC aggregation. A drug loading and/or an average drug loading of more than about 8 may also affect stability of the ADC, due to loss of one or more chemical bonds required to stabilize the antibody or antigen-binding fragment.

The present disclosure includes methods of producing the described ADCs. Briefly, in some embodiments, the ADCs comprise an antibody or antigen-binding fragment as the antibody or antigen-binding fragment, a drug moiety (e.g., a splicing modulator), and a linker that joins the drug moiety and the antibody or antigen-binding fragment. In some embodiments, the ADCs can be prepared using a linker having reactive functionalities for covalently attaching to the drug moiety and to the antibody or antigen-binding fragment. For example, in some embodiments, a cysteine thiol of an antibody or antigen-binding fragment can form a bond with a reactive functional group of a linker or a drug-linker intermediate (e.g., a maleimide moiety, e.g., MC) to make an ADC. The generation of the ADCs can be accomplished by any technique known to the skilled artisan.

In some embodiments, the present disclosure provides a method of producing an ADC by reacting an antibody or antigen-binding fragment described herein with a linker attached to a splicing modulator under conditions that allow conjugation. The linker-splicing modulator compound may or may not be subjected to a purification step prior to contacting the antibody or antigen-binding fragment.

In some embodiments, the present disclosure provides a method of producing an ADC by reacting an antibody or antigen-binding fragment described herein with a linker and a splicing modulator under conditions that allow conjugation. In some embodiments, the method comprises reacting the antibody or antigen-binding fragment with the linker and the splicing modulator sequentially, wherein first the antibody or antigen-binding fragment reacts with the linker to form an antibody-linker intermediate, and then the antibody-linker intermediate reacts with the splicing modulator. The antibody-linker intermediate may or may not be subjected to a purification step prior to contacting the splicing modulator. In some embodiments, the method comprises reacting the antibody or antigen-binding fragment with the linker and the splicing modulator simultaneously. In this method, in some embodiments, the antibody or antigen-binding fragment contacts the linker and the splicing modulator in one reaction mixture, allowing simultaneous formation of the covalent bonds between the antibody or antigen-binding fragment and the linker, and between the linker and the splicing modulator. This method of producing ADCs may include a reaction, wherein the antibody or antigen-binding fragment contacts the antibody or antigen-binding fragment prior to the addition of the linker to the reaction mixture, and vice versa.

In some embodiments of the methods disclosed herein, the linker is a cleavable linker. In some embodiments, the cleavable linker comprises MC-Val-Cit-pABC. In some embodiments, the cleavable linker comprises MC-Val-Ala-pABC. In some embodiments, the cleavable linker comprises MC-Ala-Ala-Asp-pABC. In some embodiments, the cleavable linker comprises MC-Glu-Val-Cit-pABC. In some embodiments, the cleavable linker comprises MC-(PEG)$_2$-Val-Cit-pABC. In some embodiments, the cleavable linker comprises MC-β-glucuronide. In some embodiments, the splicing modulator comprises D1. In some embodiments, the splicing modulator comprises D2. In some embodiments, an ADC is produced by reacting an antibody or antigen-binding fragment with a linker joined to a drug moiety, such as ADL1-splicing modulator (e.g., ADL1-D1), under conditions that allow conjugation.

The ADCs prepared according to the methods described above may be subjected to a purification step. The purification step may involve any biochemical methods known in the art for purifying proteins, or any combination of methods thereof. These include, but are not limited to, tangential flow filtration (TFF), affinity chromatography, ion exchange chromatography, any charge or isoelectric point-based chromatography, mixed mode chromatography, e.g., CHT (ceramic hydroxyapatite), hydrophobic interaction chromatography, size exclusion chromatography, dialysis, filtration, selective precipitation, or any combination thereof.

Pharmaceutical Compositions

In some embodiments, the present disclosure further provides pharmaceutical compositions comprising one or more antibodies, antigen-binding fragments, conjugates, and/or ADCs disclosed herein and at least one pharmaceutically acceptable carrier.

Suitable carriers include any material that, when combined with the therapeutic composition, retains the anti-cancer function of the therapeutic composition and is generally non-reactive with a patient's immune system. Pharmaceutically acceptable carriers include any and all solvents, dispersion media, coatings, antibacterial and anti-fungal agents, isotonic and absorption delaying agents, and the like that are physiologically compatible. Examples of pharmaceutically acceptable carriers include one or more of water, saline, phosphate buffered saline (PBS), histidine, dextrose, glycerol, ethanol, mesylate salt, and the like, as well as combinations thereof. In some embodiments, isotonic agents, for example, sugars, polyalcohols such as mannitol, sorbitol, or sodium chloride, are included in the composition. Pharmaceutically acceptable carriers may further comprise minor amounts of auxiliary substances such as wetting or emulsifying agents, preservatives or buffers, which enhance the shelf life or effectiveness of the antibody, antigen-binding fragment, conjugate, and/or ADC.

In some embodiments, the pharmaceutical compositions described herein comprise multiple copies of an antibody, antigen-binding fragment, conjugate, and/or ADC disclosed herein. In some embodiments, a pharmaceutical composition comprises multiple copies of an ADC disclosed herein, wherein the average p of the ADCs in the composition is from about 2 to about 8. In some embodiments, the average p of the ADCs in the composition is about 4.

In some embodiments, the pharmaceutical compositions described herein comprise at least one additional agent. In some embodiments, a pharmaceutical composition may comprise one or more additional therapeutic agents, e.g., one or more agents capable of treating a BCMA-expressing cancer. Non-limiting examples of such therapeutic agents include BCL2 inhibitors, BCLxL inhibitors, BCL2/BCLxL inhibitors, and gamma secretase inhibitors. In some embodiments, the one or more additional therapeutic agents comprise a BCL2 inhibitor, a BCLxL inhibitor, a BCL2/BCLxL inhibitor, and/or a gamma secretase inhibitor.

Therapeutic Uses and Compositions

Disclosed herein are methods of using the disclosed antibodies, antigen-binding fragments, conjugates (e.g., ADCs), and/or pharmaceutical compositions in treating a subject for a cancer or other proliferative disorders, e.g., those involving aberrant expression of BCMA. The antibodies, antigen-binding fragments, and/or ADCs may be administered alone or in combination with one or more additional therapeutic agents, and may be administered in any pharmaceutically acceptable formulation, dosage, and dosing regimen. The antibody, antigen-binding fragment, and/or ADC treatment efficacy may be evaluated for toxicity as well as indicators of efficacy and adjusted accordingly. Efficacy measures include, but are not limited to, a cytostatic and/or cytotoxic effect observed in vitro or in vivo, reduced tumor volume, tumor growth inhibition, and/or prolonged survival.

Methods of determining whether an antibody, antigen-binding fragment, and/or ADC exerts a cytostatic and/or cytotoxic effect on a cell are known. For example, the cytotoxic or cytostatic activity of an antibody, antigen-binding fragment, and/or ADC can be measured by: exposing mammalian cells expressing a target protein of the antibody, antigen-binding fragment, and/or ADC in a cell culture medium; culturing the cells for a period from about 6 hours to about 6 days; and measuring cell viability. Cell-based in vitro assays may be used to measure viability, proliferation, cytotoxicity, and induction of apoptosis (caspase activation) of an antibody, antigen-binding fragment, and/or ADC. Determination of any of these effects on cancer cells may indicate that an antibody, antigen-binding fragment, and/or ADC is useful in the treatment of cancers.

Cell viability may be measured, e.g., using a CellTiter-Glo® 2.0 Luminescent Cell Viability Assay. Cell viability may also be measured, e.g., by determining in a cell the uptake of a dye such as neutral red, trypan blue, Crystal Violet, or ALAMAR™ blue (see, e.g., Page et al. (1993) Intl. J. Oncology 3:473-6). In such an assay, the cells are incubated in media containing the dye, the cells are washed, and the remaining dye, reflecting cellular uptake of the dye, is measured spectrophotometrically. In some embodiments, in vitro potency and/or cytotoxicity of prepared antibodies, antigen-binding fragments, and/or ADCs is assessed using a Crystal Violet assay. Crystal Violet is a triarylmethane dye that accumulates in the nucleus of viable cells. In this assay, cells are exposed to the antibodies, antigen-binding fragments, and/or ADCs or control agents for a defined period of time, after which, cells are stained with Crystal Violet, washed copiously with water, then solubilized with 1% SDS and read spectrophotometrically. The protein-binding dye sulforhodamine B (SRB) can also be used to measure cytotoxicity (Skehan et al. (1990) J. Natl. Cancer Inst. 82:1107-12).

For determining cytotoxicity, necrosis or apoptosis (programmed cell death) may be measured. Necrosis is typically accompanied by increased permeability of the plasma membrane, swelling of the cell, and rupture of the plasma membrane. Apoptosis is typically characterized by membrane blebbing, condensation of cytoplasm, and the activation of endogenous endonucleases. Apoptosis can be quantitated, for example, by measuring DNA fragmentation. Commercial photometric methods for the quantitative in vitro determination of DNA fragmentation are available. Examples of such assays, including TUNEL (which detects incorporation of labeled nucleotides in fragmented DNA) and ELISA-based assays, are described in Biochemica (1999) No. 2, pp. 34-37 (Roche Molecular Biochemicals).

Apoptosis may also be determined by measuring morphological changes in a cell. For example, as with necrosis, loss of plasma membrane integrity can be determined by measuring uptake of certain dyes (e.g., a fluorescent dye such as, for example, acridine orange or ethidium bromide). An exemplary method for measuring apoptotic cell number has been described by Duke and Cohen, Current Protocols in Immunology (Coligan et al., eds. (1992) pp. 3.17.1-3.17.16). Cells can also be labeled with a DNA dye (e.g., acridine orange, ethidium bromide, or propidium iodide) and the cells observed for chromatin condensation and margination along the inner nuclear membrane. Other morphological changes that can be measured to determine apoptosis include, e.g., cytoplasmic condensation, increased membrane blebbing, and cellular shrinkage.

The disclosed ADCs may also be evaluated for bystander killing activity. Bystander killing activity may be determined, e.g., by an assay employing two cell lines, one positive for a target antigen and one negative for a target antigen. In certain embodiments, the design of the assay allows tracking of only target negative cells. In certain embodiments, cells are plated under three conditions: (i) target negative cells alone (tagged or labeled); (ii) target positive cells alone; and (iii) co-culture of target negative cells and target positive cells. Cells are then treated with an ADC followed by monitoring of cytotoxicity. When plates are read with CellTiter-Glo® Reagent, viability of all cell populations can be monitored. When plates are read with OneGlo® Reagent, only the tagged or labeled target negative cells produce a signal. Killing of the target-negative cells when mixed with target-positive cells is indicative of bystander killing, whereas killing of the target-negative cells in the absence of the target-positive cells is indicative of off-target killing.

In certain aspects, the present disclosure features a method of killing, inhibiting or modulating the growth of, or interfering with the metabolism of, a cancer cell or tissue by disrupting RNA splicing. The method may be used with any subject where disruption of RNA splicing provides a therapeutic benefit. Subjects that may benefit from disrupting RNA splicing include, but are not limited to, those having or at risk of having a cancer (e.g., a BCMA-expressing cancer). In some embodiments, the cancer is a hematological malignancy. In some embodiments, the cancer is a B-cell malignancy, a cancer of the blood (leukemia), a cancer of plasma cells (myeloma, e.g., multiple myeloma), or a cancer of the lymph nodes (lymphoma). In some embodiments, the cancer is a lymphoid or a myeloid malignancy. In some embodiments, the cancer is a plasma cell disease or cancer such as multiple myeloma, monoclonal gammopathy of undetermined (or unknown or unclear) significance (MGUS), plasmacytoma (bone, extramedullary), lymphoplasmacytic lymphoma (LPL), Waldenström's macroglobulinemia, plasma cell leukemia, and primary amyloidosis (AL). In some embodiments, the cancer is a cancer of another type of hematopoietic cell, including polymorphonuclear leukocytes (or neutrophils), basophils, eosinophils, dendritic cells, platelets, erythrocytes, and natural killer cells. In some embodiments, the cancer is a plasma cell malignancy, wherein the plasma cell malignancy expresses BCMA. In some embodiments, the plasma cell malignancy or cancer is a leukemia, lymphoma, plasmacytoma, or myeloma. In some embodiments, plasma cell malignancy or cancer is multiple myeloma, diffuse large B-cell lymphoma, mantle cell lymphoma, plasmablastic lymphoma, plasmablastic myeloma, or Burkitt's lymphoma. In some embodiments, the plasma cell malignancy or cancer is multiple myeloma. In some embodiments, the plasma cell malignancy or cancer is relapsed/refractory multiple myeloma.

In some embodiments, the antibodies, antigen-binding fragments, ADCs, and/or pharmaceutical compositions described herein may be used to treat multiple myeloma. In some embodiments, the multiple myeloma is relapsed/refractory multiple myeloma.

In various embodiments, the disclosed antibodies, antigen-binding fragments, and/or ADCs may be contacted with and/or administered to any cell or tissue that expresses BCMA. An exemplary embodiment includes a method of inhibiting BCMA-mediated cell signaling or a method of killing a cell. The method may be used with any cell or tissue that expresses BCMA, such as a cancerous cell or a metastatic lesion. Non-limiting examples of BCMA-expressing cells include plasma cells, human myeloma NCI-H929 cells (high cell surface BCMA density), human myeloma OPM2 cells (moderate cell surface BCMA density), human myeloma MOLP8 cells (moderate cell surface BCMA density), and cells comprising a recombinant nucleic acid encoding BCMA or a portion thereof.

Exemplary methods include the steps of contacting a cell with an antibody, antigen-binding fragment, and/or ADC, as described herein, in an effective amount, e.g., an amount sufficient to kill the cell and/or sufficient to see a reduction or slowing in the growth rate of a cancer. The method can be used on cells in culture (e.g., in vitro), in vivo, ex vivo, or in situ. For example, cells that express BCMA (e.g., cells collected by biopsy of a tumor or metastatic lesion; cells collected from blood or from bone marrow aspiration; cells from an established cancer cell line; or recombinant cells), can be cultured in vitro in culture medium and the contacting step can be affected by adding the antibody, antigen-binding fragment, and/or ADC to the culture medium. In some embodiments, the method will result in killing of cells expressing BCMA, including in particular cancer cells expressing BCMA. Alternatively, in some embodiments, the antibody, antigen-binding fragment, and/or ADC can be administered to a subject by any suitable administration route (e.g., intravenous, subcutaneous, or direct contact with cancer cells or tissue) to have an effect in vivo.

The in vivo effect of a disclosed antibody, antigen-binding fragment, and/or ADC therapeutic composition may be evaluated in a suitable animal model. For example, xenogeneic cancer models can be used, wherein cancer explants or passaged xenograft tissues are introduced into immune compromised animals, such as nude or SCID mice (Klein et al. (1997) Nature Med. 3:402-8). Efficacy may be predicted using assays that measure inhibition of tumor formation, tumor regression or metastasis, and the like. In vivo assays that evaluate the promotion of tumor death by mechanisms such as apoptosis may also be used. In some embodiments, xenografts from tumor-bearing mice treated with the therapeutic composition can be examined for the presence of apoptotic foci and compared to untreated control xenograft-bearing mice. The extent to which apoptotic foci are found in the tumors of the treated mice provides an indication of the therapeutic efficacy of the composition.

Further provided herein are methods of treating cancer. The antibodies, antigen-binding fragments, and/or ADCs disclosed herein can be administered to a subject (e.g., a non-human mammal or human) for therapeutic purposes. In some embodiments, the methods comprise administering to a subject having or suspected of having a cancer a therapeutically effective amount of an antibody, antigen-binding fragment, and/or ADC that binds to an antigen expressed, is accessible to binding, or is localized on a cancer cell surface (e.g., BCMA). In some embodiments, the antibody, antigen-binding fragment, and/or ADC is formulated in a pharmaceutical composition disclosed herein.

In some embodiments, the present disclosure provides a method of delivering a splicing modulator to a cell expressing BCMA, comprising conjugating the splicing modulator to an antibody or antigen-binding fragment that immunospecifically binds to a BCMA epitope and exposing the cell to the ADC. Exemplary cancer cells that express BCMA for which the antibodies, antigen-binding fragments, and/or ADCs of the present disclosure are indicated include multiple myeloma cells, diffuse large B-cell lymphoma cells, mantle cell lymphoma cells, plasmablastic lymphoma cells, plasmablastic myeloma cells, and Burkitt's lymphoma cells.

In some embodiments, the present disclosure provides a method of treating a subject having or suspected of having a cancer by administering to the subject a therapeutically effective amount and/or regimen of any one of the antibodies, antigen-binding fragments, ADCs, and/or pharmaceutical compositions described herein.

In some embodiments, the present disclosure provides a method of reducing or slowing the growth of a cancer cell population in a subject by administering to the subject a therapeutically effective amount and/or regimen of any one of the antibodies, antigen-binding fragments, ADCs, and/or pharmaceutical compositions described herein. In some embodiments, administration of the antibody, antigen-binding fragment, ADC, and/or pharmaceutical composition reduces the cancer cell population by at least about 10%, at least about 20%, at least about 50%, at least about 70%, at least about 80%, at least about 90%, at least about 95%, or at least about 99%. In some embodiments, administration of the antibody, antigen-binding fragment, ADC, and/or pharmaceutical composition slows the growth of the cancer cell population by at least about 10%, at least about 20%, at least about 50%, at least about 70%, at least about 80%, at least about 90%, at least about 95%, or at least about 99%.

In some embodiments, treatment with an antibody, antigen-binding fragment, ADC, and/or pharmaceutical composition described herein is sufficient to reduce or slow the growth of a cancer cell population, reduce or inhibit the growth of a tumor, reduce the number or size of metastatic lesions, reduce tumor load, reduce primary tumor load, reduce invasiveness, prolong survival time, and/or maintain or improve the quality of life in the subject. In some embodiments, the cancer cell population and/or tumor is resistant or refractory to treatment with the antibody or antigen-binding fragment of an ADC (e.g., an anti-BCMA antibody) when administered alone, and/or the cancer cell population and/or tumor is resistant or refractory to treatment with the splicing modulator drug moiety of an ADC (e.g., a splicing modulator described herein) when administered alone.

Moreover, an antibody, antigen-binding fragment, and/or ADC of the present disclosure may be administered to a non-human mammal for veterinary purposes or as an animal model of human disease. Regarding the latter, such animal models may be useful for evaluating the therapeutic efficacy of the disclosed antibodies, antigen-binding fragments, and/or ADCs (e.g., testing of dosages and time courses of administration).

Further provided herein are therapeutic uses of the disclosed antibodies, antigen-binding fragments, and/or ADCs, e.g., in treating cancer. In some embodiments, the present disclosure provides an antibody, antigen-binding fragment, ADC, and/or pharmaceutical composition described herein for use in treating a subject having or suspected of having a cancer (e.g., a BCMA-expressing cancer). In some embodiments, the present disclosure provides a use of an antibody, antigen-binding fragment, ADC, and/or pharmaceutical composition described herein in treating a subject having or suspected of having a cancer (e.g., a BCMA-expressing cancer). In some embodiments, the present disclosure provides a use of an antibody, antigen-binding fragment, ADC, and/or pharmaceutical composition described herein in a method of manufacturing a medicament for treating a subject having or suspected of having a cancer (e.g., a BCMA-expressing cancer). Methods for identifying subjects having cancers that express a target antigen (e.g., BCMA), such as those disclosed herein, may be used to identify suitable patients for treatment with a disclosed antibody, antigen-binding fragment, ADC, and/or pharmaceutical composition.

Further provided herein are therapeutic uses of the disclosed antibodies, antigen-binding fragments, and/or ADCs, e.g., in determining whether a subject having or suspected of having a cancer (e.g., a BCMA-expressing cancer) will be responsive to treatment with an agent targeting BCMA, e.g., an antibody, antigen-binding fragment, ADC, and/or pharmaceutical composition described herein. Subjects may be evaluated for the levels of target antigen in a sample (e.g., the levels of BCMA-expressing cells) in order to assist in determining the most effective dosing regimen, etc. In some embodiments, the method comprises providing a biological sample from the subject; contacting the sample with an antibody or antigen-binding fragment disclosed herein; and detecting binding of the antibody or antigen-binding fragment to one or more cancer cells in the sample. In some embodiments, the one or more cancer cells express BCMA. In some embodiments, the cancer expresses BCMA. In some embodiments, the cancer is a plasma cell malignancy. In some embodiments, the plasma cell malignancy or cancer is a leukemia, lymphoma, plasmacytoma, or myeloma. In some embodiments, plasma cell malignancy or cancer is multiple myeloma, diffuse large B-cell lymphoma, mantle cell lymphoma, plasmablastic lymphoma, plasmablastic myeloma, or Burkitt's lymphoma. In some embodiments, the plasma cell malignancy or cancer is multiple myeloma. In some embodiments, the plasma cell malignancy or cancer is relapsed/refractory multiple myeloma.

Exemplary biological samples include tissue or body fluid, such as an inflammatory exudate, blood, serum, bowel fluid, stool, tumor biopsy, or bone marrow aspiration sample. In some embodiments, the biological sample is a blood sample or a bone marrow aspiration sample. In some embodiments, the blood sample is blood, a blood fraction, or one or more cells obtained from blood or a blood fraction. In some embodiments, the biological sample (e.g., a tissue and/or body fluid) is obtained from a subject having or suspected of having a cancer (e.g., a BCMA-expressing cancer). In some embodiments, a suitable immunological method can be used to detect and/or measure protein expression of the target antigen (e.g., BCMA) in the sample. Such evaluations are also used for monitoring purposes throughout therapy and/or for gauging therapeutic success in combination with the evaluation of other parameters.

In some embodiments, the antibodies, antigen-binding fragments, and/or ADCs of the present disclosure are useful as therapeutic agents, e.g., to treat, prevent, and/or diagnose a BCMA-expressing cancer. Exemplary cancers that express BCMA include but are not limited to multiple myeloma, diffuse large B-cell lymphoma, mantle cell lymphoma, plasmablastic lymphoma, plasmablastic myeloma, and Burkitt's lymphoma. In some embodiments, the cancer is a plasma cell malignancy. In some embodiments, the plasma cell malignancy or cancer is a leukemia, lymphoma, plasmacytoma, or myeloma. In some embodiments, the plasma cell malignancy or cancer is multiple myeloma, diffuse large B-cell lymphoma, mantle cell lymphoma, plasmablastic lymphoma, plasmablastic myeloma, or Burkitt's lymphoma. In some embodiments, the plasma cell malignancy or cancer is multiple myeloma. In some embodiments, the plasma cell malignancy or cancer is relapsed/refractory multiple myeloma. In some embodiments, the plasma cell malignancy or cancer comprises actively-dividing cells, dormant cells, or both. In some embodiments, the described antibodies, antigen-binding fragments, conjugates, and/or ADC compounds retain cytotoxic and/or cytostatic activity independent of cell proliferation status. In some embodiments, the described antibodies, antigen-binding fragments, conjugates, and/or ADC compounds can target both actively-dividing and dormant cells (e.g., actively-dividing, non-dividing, and/or slowly-dividing myeloma cells).

In some embodiments of the methods and uses disclosed herein, an antibody, antigen-binding fragment, and/or ADC of the present disclosure is administered or used in combination with one or more additional therapeutic agents. Such exemplary therapeutic agents include but are not limited to BCL2 inhibitors, BCLxL inhibitors, BCL2/BCLxL inhibitors, and gamma secretase inhibitors. In some embodiments, the one or more additional therapeutic agents comprise a BCL2 inhibitor, a BCLxL inhibitor, a BCL2/BCLxL inhibitor, and/or a gamma secretase inhibitor. In some embodiments, the treatments (e.g., an anti-BCMA antibody, antigen-binding fragment, and/or ADC of the present disclosure and at least one additional therapeutic agent, e.g., a BCL2 inhibitor, etc.) are comprised in the same composition. Such compositions may be administered in any appropriate form and by any suitable route. In other embodiments, the treatments (e.g., an anti-BCMA antibody, antigen-binding fragment, and/or ADC of the present disclosure and at least one additional therapeutic agent, e.g., a BCL2 inhibitor, etc.) are administered in separate compositions, in any appropriate form and by any suitable route. For example, a composition comprising an anti-BCMA antibody, antigen-binding fragment, and/or ADC of the present disclosure and a composition comprising an additional therapeutic agent may be administered concurrently or sequentially, in any order at different points in time; in either case, they should be administered sufficiently close in time so as to provide the desired therapeutic or prophylactic effect.

In some embodiments, the therapeutic compositions used in the methods and uses disclosed herein are formulated into pharmaceutical compositions comprising a pharmaceutically acceptable diluent, carrier, and/or excipient suitable for the desired delivery method. An exemplary embodiment is a pharmaceutical composition comprising an antibody or antigen-binding fragment, and/or ADC of the present disclosure and a pharmaceutically acceptable carrier.

Therapeutic formulations may be solubilized and administered via any route capable of delivering the therapeutic composition to the cancer. Potentially effective routes of administration include, but are not limited to, intravenous, parenteral, intraperitoneal, intramuscular, intratumor, intradermal, intraorgan, orthotopic, and the like. Therapeutic protein preparations can be lyophilized and stored as sterile powders, e.g., under vacuum, and then reconstituted in bacteriostatic water (containing for example, benzyl alcohol preservative) or in sterile water prior to injection. Therapeutic formulations may comprise an antibody, antigen-binding fragment, and/or ADC, or a pharmaceutically acceptable salt thereof, e.g., a mesylate salt.

In some embodiments, an antibody, antigen-binding fragment, and/or ADC is administered to the patient daily, bimonthly, or any time period in between. Dosages and administration protocols for the treatment of cancers using the foregoing methods will vary with the method and the target cancer, and will generally depend on other factors appreciated in the art.

Various delivery systems are known and may be used to administer one or more antibodies, antigen-binding fragments, and/or ADCs of the present disclosure. Methods of administering the antibodies, antigen-binding fragments, and/or ADCs include, but are not limited to, parenteral administration (e.g., intradermal, intramuscular, intraperitoneal, intravenous and subcutaneous), epidural administration, intratumoral administration, and mucosal administration (e.g., intranasal and oral routes). In addition, pulmonary administration may be employed, e.g., by use of an inhaler or nebulizer, and formulation with an aerosolizing agent. See, e.g., the compositions and methods for pulmonary administration described in U.S. Pat. Nos. 6,019,968, 5,985,320, 5,985,309, 5,934,272, 5,874,064, 5,855,913, 5,290,540, and 4,880,078; and Intl. Publ. Nos. WO 1992/019244, WO 1997/032572, WO 1997/044013, WO 1998/031346, and WO 1999/066903. The antibodies, antigen-binding fragments, and/or ADCs may be administered by any convenient route, for example, by infusion or bolus injection, or by absorption through epithelial or mucocutaneous linings (e.g., oral mucosa, rectal and intestinal mucosa, etc.). Administration can be either systemic or local. In some embodiments of the methods and uses disclosed herein, treatment with an antibody, antigen-binding fragment, and/or ADC of the present disclosure involves a single bolus dose or repeated doses of the antibody, antigen-binding fragment, and/or ADC preparation via an acceptable route of administration.

The therapeutic compositions disclosed herein may be sterile and stable under the conditions of manufacture and storage. In some embodiments, one or more of the antibodies, antigen-binding fragments, and/or ADCs, or a pharmaceutical composition thereof, is supplied as a dry sterilized lyophilized powder or water free concentrate in a hermetically sealed container and can be reconstituted (e.g., with water or saline) to the appropriate concentration for administration to a subject. In some embodiments, one or more of the therapeutic agents or pharmaceutical compositions is supplied as a dry sterile lyophilized powder in a hermetically sealed container at a unit dosage of at least 5 mg, at least 10 mg, at least 15 mg, at least 25 mg, at least 35 mg, at least 45 mg, at least 50 mg, at least 75 mg, or at least 100 mg, or any amount in between. In some embodiments, the lyophilized antibodies, antigen-binding fragments, and/or ADCs or pharmaceutical compositions is stored at between 2° C. and 8° C. in the original container. In some embodiments, one or more of the antibodies, antigen-binding fragments, and/or ADCs, or a pharmaceutical composition thereof, is supplied in liquid form in a hermetically sealed container, e.g., a container indicating the quantity and concentration of the agent. In some embodiments, the liquid form of the administered composition is supplied in a hermetically sealed container of at least 0.25 mg/mL, at least 0.5 mg/mL, at least 1 mg/mL, at least 2.5 mg/mL, at least 5 mg/mL, at least 8 mg/mL, at least 10 mg/mL, at least 15 mg/mL, at least 25 mg/mL, at least 50 mg/mL, at least 75 mg/mL, or at least 100 mg/mL ADC. The liquid form may be stored at between 2° C. and 8° C. in the original container.

In some embodiments, the disclosed antibodies, antigen-binding fragments, and/or ADCs can be incorporated into a pharmaceutical composition suitable for parenteral administration. The injectable solution may be composed of either a liquid or lyophilized dosage form in a flint or amber vial, ampule, or pre-filled syringe, or other known delivery or storage device. The therapeutic compositions described herein may also be in a variety of forms. These include, for example, liquid, semi-solid, and solid dosage forms, such as liquid solutions (e.g., injectable and infusible solutions), dispersions or suspensions, tablets, pills, powders, liposomes, and suppositories. The form depends on the intended mode of administration and therapeutic application.

In some embodiments, the efficacy of an antibody, antigen-binding fragment, and/or ADC may be evaluated by contacting a tumor sample from a subject with the antibody, antigen-binding fragment, and/or ADC and evaluating tumor growth rate or volume. In some embodiments, when an antibody, antigen-binding fragment, and/or ADC has been determined to be effective, it may be administered to the subject.

The above therapeutic approaches can be combined with any one of a wide variety of additional surgical, chemotherapy, or radiation therapy regimens. In some embodiments, the antibodies, antigen-binding fragments, and/or ADCs disclosed herein are co-formulated and/or co-administered with one or more additional therapeutic agents, e.g., one or more chemotherapeutic agents. In some embodiments, the delivery of a first treatment is still occurring when the delivery of a second treatment begins, so that there is overlap. In some embodiments, a first and a second treatment are initiated at the same time. These types of delivery may be referred to as "simultaneous," "concurrent," or "concomitant" delivery. In other embodiments, the delivery of a first treatment ends before delivery of a second treatment begins. This type of delivery may be referred to as "successive" or "sequential" delivery. In some embodiments, an anti-BCMA antibody, antigen-binding fragment, and/or ADC of the present disclosure and at least one additional therapeutic regimen and/or agent are administered simultaneously. In some embodiments, an anti-BCMA antibody, antigen-binding fragment, and/or ADC of the present disclosure and at least one additional therapeutic regimen and/or agent are administered sequentially.

Non-limiting examples of chemotherapeutic agents include alkylating agents, for example, nitrogen mustards, ethyleneimine compounds, and alkyl sulphonates; antimetabolites, for example, folic acid, purine or pyrimidine antagonists; anti-mitotic agents, for example, anti-tubulin agents such as eribulin or eribulin mesylate (Halaven™), vinca alkaloids, and auristatins; cytotoxic antibiotics; compounds that damage or interfere with DNA expression or replication, for example, DNA minor groove binders; and growth factor receptor antagonists. In some embodiments, a chemotherapeutic agent may be a cytotoxic or cytostatic agent. Examples of cytotoxic agents include, but are not limited to, anti-mitotic agents, such as eribulin or eribulin mesylate (Halaven™), auristatins (e.g., monomethyl auristatin E (MMAE), monomethyl auristatin F (MMAF)), maytansinoids (e.g., maytansine), dolastatins, duostatins, cryptophycins, vinca alkaloids (e.g., vincristine, vinblastine), taxanes, taxols, and colchicines; anthracyclines (e.g., daunorubicin, doxorubicin, dihydroxyanthracindione); cytotoxic antibiotics (e.g., mitomycins, actinomycins, duocarmycins (e.g., CC-1065), auromycins, duomycins, calicheamicins, endomycins, phenomycins); alkylating agents (e.g., cisplatin); intercalating agents (e.g., ethidium bromide); topoisomerase inhibitors (e.g., etoposide, tenoposide); radioisotopes, such as $At^{211}$, $I^{131}$, $I^{125}$, $Y^{90}$, $Re^{186}$, $Re^{188}$, $Sm^{153}$, $Bi^{212}$ or $^{213}$, $P^{32}$, and radioactive isotopes of lutetium (e.g., $Lu^{177}$); and toxins of bacterial, fungal, plant or animal origin (e.g., ricin (e.g., ricin A-chain), diphtheria toxin, *Pseudomonas* exotoxin A (e.g., PE40), endotoxin, mitogellin, combrestatin, restrictocin, gelonin, alpha-sarcin, abrin (e.g., abrin A-chain), modeccin (e.g., modeccin A-chain), curicin, crotin, *Sapaonaria officinalis* inhibitor, glucocorticoid). In some embodiments, the antibodies, antigen-binding fragments, and/or ADCs disclosed herein are co-formulated and/or co-administered with one or more BCL2 inhibitors, BCLxL inhibitors, BCL2/BCLxL inhibitors, and/or gamma secretase inhibitors In some embodiments, kits for use in the laboratory and therapeutic applications described herein are within the scope of the present disclosure. Such kits may comprise a carrier, package, or container that is compartmentalized to receive one or more containers such as vials, tubes, and the like, each of the containers comprising one of the separate elements to be used in a method disclosed herein, along with a label or insert comprising instructions for use, such as a use described herein. Kits may comprise a container comprising a drug moiety. The present disclosure also provides one or more of the antibodies, antigen-binding fragments, and/or ADCs, or a pharmaceutical composition thereof, packaged in a hermetically sealed container, such as an ampoule or sachette, indicating the quantity of the agent.

Kits may comprise a container as described above, and one or more other containers associated therewith that comprise materials desirable from a commercial and user standpoint, including buffers, diluents, filters, needles, syringes; carrier, package, container, vial and/or tube labels listing contents and/or instructions for use; and package inserts with instructions for use.

A label may be present on or with the container to indicate that the composition is used for a specific therapy or non-therapeutic application, such as a prognostic, prophylactic, diagnostic, or laboratory application. A label may also indicate directions for either in vivo or in vitro use, such as those described herein. Directions and or other information may also be included on an insert and/or label, which is included with and/or on the kit. A label may be on or associated with the container. A label may be on a container when letters, numbers, or other characters forming the label are molded or etched into the container itself. A label may be associated with a container when it is present within a receptacle or carrier that also holds the container, e.g., as a package insert. The label may indicate that the composition is used for diagnosing or treating a condition, such as a cancer described herein.

EXAMPLES

The following examples provide illustrative embodiments of the disclosure. One of ordinary skill in the art will recognize the numerous modifications and variations that may be performed without altering the spirit or scope of the disclosure. Such modifications and variations are encompassed within the scope of the disclosure. The examples do not in any way limit the disclosure.

Example 1

Synthesis methods for payloads, linkers, and conjugatable linker-payload (linker-drug, L-D) compounds having the structures shown in Tables 12-14 are described. Conjugatable linker-payloads were used in the preparation of antibody-drug conjugates (ADCs). Exemplary ADCs are described in Examples 4-6.

1.1 Reagents and Materials

The described conjugatable linker-payloads can be prepared using the reactions and techniques described herein. In the description of the synthetic methods described below, it is to be understood that all proposed reaction conditions, including choice of solvent, reaction atmosphere, reaction temperature, duration of the experiment, and workup procedures, can be chosen or modified to use the conditions standard for that reaction, unless otherwise indicated.

Liquid chromatography-mass spectrometry (LC/MS) was conducted using a Waters AutoPurification System and an XTerra MS $C_{18}$ column (5 μm, 19 mm×100 mm) under acidic mobile phase conditions. Nuclear magnetic resonance (NMR) spectra were recorded at 400 MHz using a Varian instrument (Agilent Technologies). Column chromatography was carried out using a Teledyne Isco Combiflash Rf200d. Solvent removal was carried out using either a Büchi rotary evaporator manufactured by BUCHI Corporation, DE, USA and used according to the manufacturer's instructions, or a Genevac centrifugal evaporator manufactured by Genevac Ltd., United Kingdom and used according to the manufacturer's instructions.

In this example, unless indicated otherwise, (i) temperatures are given in degrees Celsius (° C.); operations are carried out at room temperature or ambient temperature, that is, in a range of 18–25° C.; (ii) organic solutions were dried over anhydrous sodium sulfate unless otherwise stated; evaporation of organic solvent was carried out using a rotary evaporator under reduced pressure (4.5-30 mmHg) with a bath temperature of up to 60° C.; (iii) chromatography means flash chromatography on silica gel; thin layer chromatography (TLC) was carried out on silica gel plates; (iv) in general, the course of reactions was followed by TLC or LC/MS and reaction times are given for illustration only; (v) final products have satisfactory proton nuclear magnetic resonance (NMR) spectra and/or mass spectra data; (vi) yields are given for illustration only; preparations were repeated if more material was required; (vii) when given, NMR data is in the form of delta values for major diagnostic protons, given in part per million (ppm) relative to tetramethylsilane (TMS) as an internal standard, and was determined at 400 MHz in $CD_3OD$ unless otherwise stated; (viii) chemical symbols have their usual meanings; (ix) solvent ratio is given in volume-to-volume (v/v) terms; (x) "ISCO" refers to normal phase flash column chromatography using pre-packed silica gel cartridges (12 g, 40 g, etc.) used according to the manufacturer's instructions and obtained from Teledyne ISCO, Inc., NE, USA; (xi) the exemplary compounds were named in accordance with IUPAC nomenclature; and (xii) Chemdraw Professional 17.0.0.206 manufactured by Perkin-Elmer Inc., MA, USA was employed for generating the IUPAC names for the exemplary compounds.

Terms/Abbreviations: As used herein, the term "inerted" refers to replacement of the air in a reactor (e.g., a reaction vessel, a flask, a glass reactor) with an essentially moisture-free, inert gas, such as nitrogen or argon. Exemplary abbreviations used herein are set forth in Table 11.

TABLE 11

Abbreviations

| Abbreviation | Meaning |
| --- | --- |
| Ala | Alanine |
| Asp | Asparagine |
| Cit | Citruline |
| DCM | Dichloromethane |
| DCE | 1,2-dichloroethane |
| DMAP | N,N-dimethyl-4-aminopyridine |
| DMF | N,N'-dimethylformamide |
| DMSO | Dimethylsulfoxide |
| DIPEA | N,N-Diisopropylethylamine |
| EtOAc | Ethyl acetate |
| Glu | Glutamic acid |
| HPLC | High performance liquid chromatography |
| LC/MS | Liquid chromatography-mass spectrometry |
| Mc | Maleimidocaproyl |
| MeOH | Methanol |
| pABC | para-aminobenzyloxycarbonyl |
| PNP | para-nitrophenol |
| PPTS | Pyridinium para-toluene sulfonate |
| RT | Room temperature |
| TEA | Triethylamine |
| TES | Triethylsilyl |
| THF | Tetrahydrofuran |
| TLC | Thin-layer chromatography |
| Val | Valine |

Multiplicities are indicated using the following abbreviations: s=singlet, d=doublet, t=triplet, q=quartet, quint=quintet, sxt=sextet, m=multiplet, dd=doublet of doublets, ddd=doublet of doublets of doublets, dt=doublet of triplets, br s=a broad singlet.

LC/MS: Mobile phases=A (0.1% formic acid in $H_2O$) and B (0.1% formic acid in acetonitrile). Gradient=B 5% to 95% in 1.8 min. Column=Waters Acquity BEH $C_{18}$ column (1.7 μm, 2.1×50 mm), used according to the manufacturer's instructions and obtained from Waters Corporation, MA, USA.

HPLC: Preparative LC/MS was conducted using a Waters mass directed autopurification system and a Waters 19×100 mm XBridge 5-micron CSH18 column under acidic conditions, used according to the manufacturer's instructions and obtained from Waters Corporation, MA, USA. Mobile phases=A (0.1% formic acid in $H_2O$) and B (0.1% formic acid in acetonitrile).

References: U.S. Pat. Nos. 7,884,128 and 7,816,401 describe exemplary methods of synthesizing pladienolide B and D and are each incorporated herein by reference for such methods. Synthesis of pladienolide B and D may also be performed using the exemplary methods described in Kanada et al. ((2007) Angew. Chem. Int. Ed. 46:4350-5). Kanada et al. and Intl. Pub. No. WO 2003/099813 describe exemplary methods for synthesizing E7107 (D11) (Compound 45 of WO 2003/099813) from pladienolide D (11107D of WO 2003/099813). A corresponding U.S. Pat. No. 7,550,503 to Kotake et al. Each of these references is incorporated herein for the described synthesis methods.

TABLE 12

Structures of exemplary drug moieties (payloads)

Payload Structure/ID

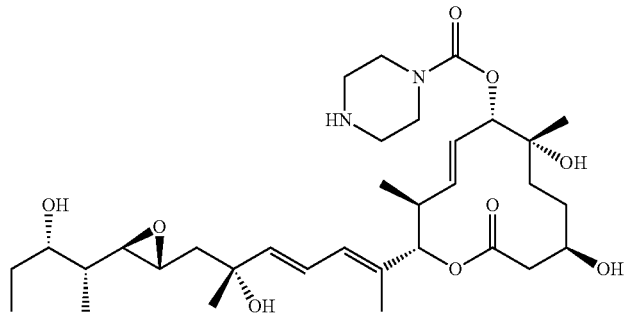

D1
(2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl piperazine-1-carboxylate

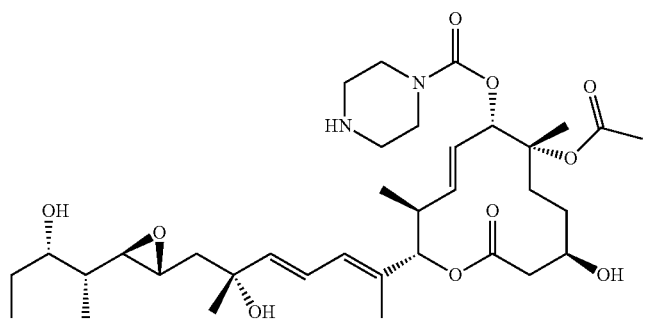

D2
(2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl piperazine-1-carboxylate

TABLE 13

Structures of exemplary linkers

Linker Structure/ID

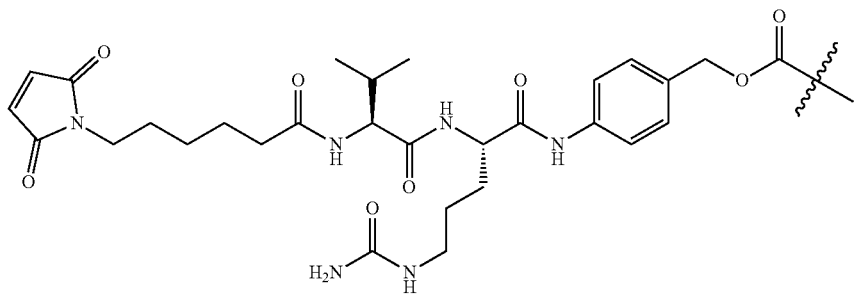

ADL1 - "MC-Val-Cit-pABC"

TABLE 13-continued
Structures of exemplary linkers
Linker Structure/ID
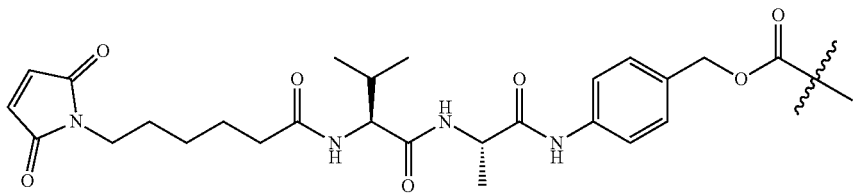
ADL6 - "MC-Val-Ala-pABC"
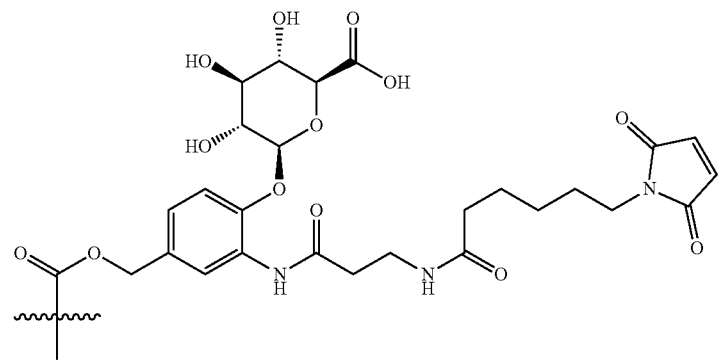
ADL13 - "MC-β-glucuronide"
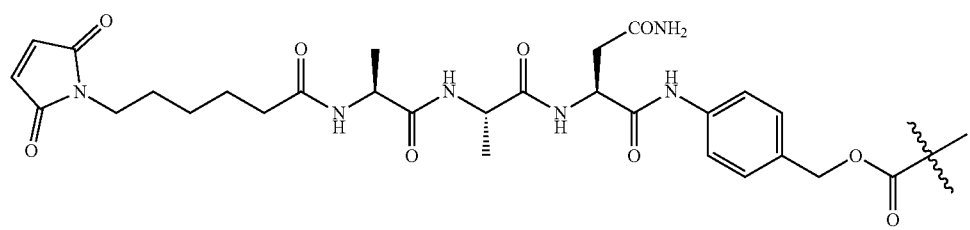
ADL21 - "MC-Ala-Ala-Asp-pABC"

TABLE 13-continued

Structures of exemplary linkers

Linker Structure/ID

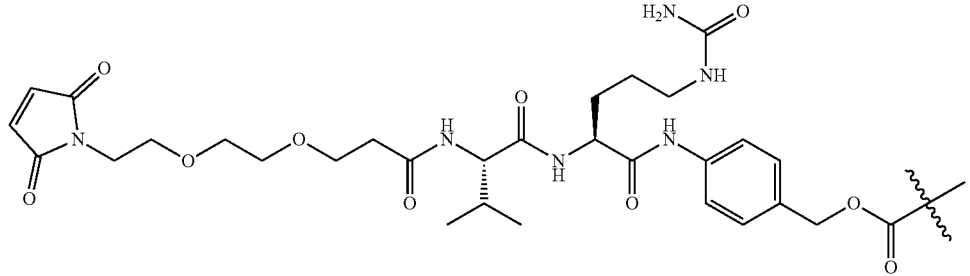

ADL22 - "MC-PEG$_2$-Val-Cit-pABC"

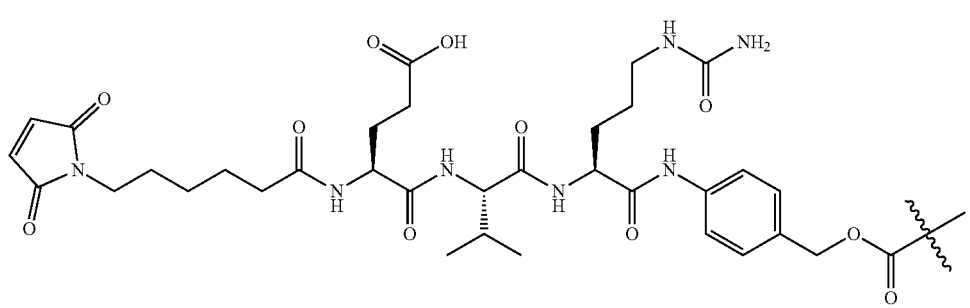

ADL23 - "MC-Glu-Val-Cit-pABC"

TABLE 14

Structures of exemplary conjugatable linker-payload (L-D) compounds

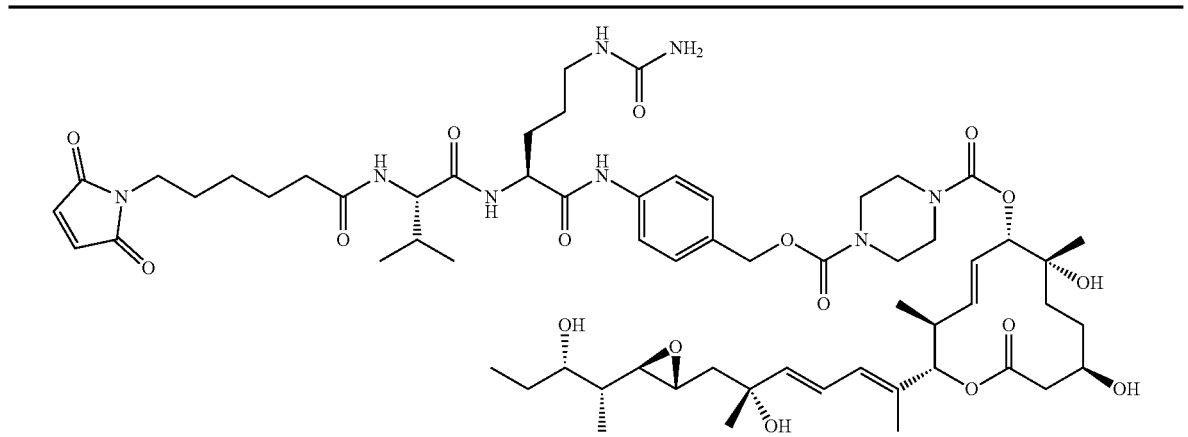

Chemical Formula: $C_{62}H_{92}N_8O_{17}$
Molecular Weight: 1221.457
ADL1-D1
1-((2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((S)-2-((S)-2-(6-(2,5-dioxo-2,5-dihydro-1H-pyrrol-1-yl)hexanamido)-3-methylbutanamido)-5-ureidopentanamido)benzyl) piperazine-1,4-dicarboxylate TABLE 14-continued Structures of exemplary conjugatable linker-payload (L-D) compounds

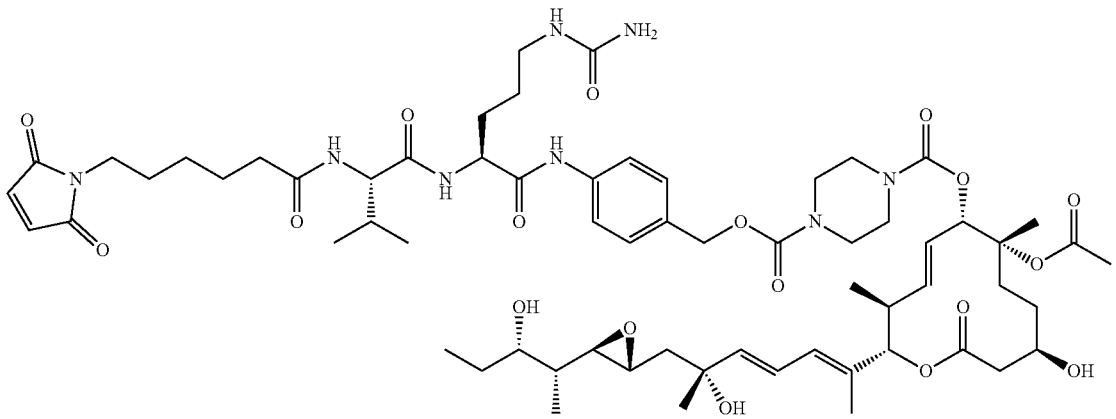

Chemical Formula: $C_{64}H_{94}N_8O_{18}$
Molecular Weight: 1263.49
ADL1-D2
1-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((S)-2-((S)-2-(6-(2,5-dioxo-2,5-dihydro-1H-pyrrol-1-yl)hexanamido)-3-methylbutanamido)-5-ureidopentanamido)benzyl) piperazine-1,4-dicarboxylate

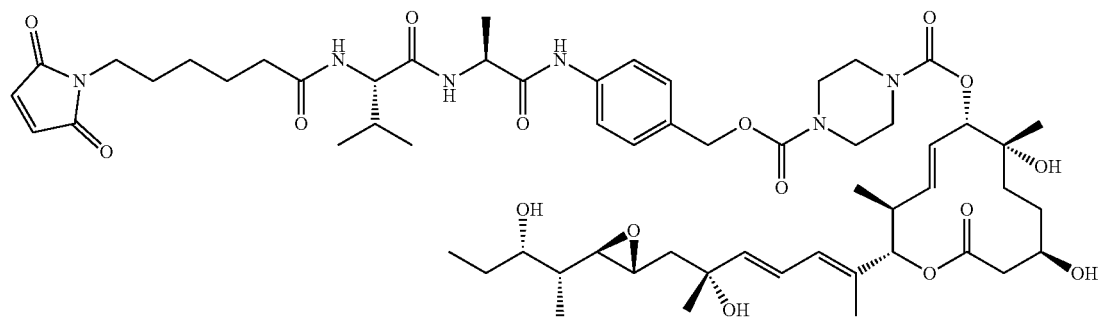

Chemical Formula: $C_{59}H_{86}N_6O_{16}$
Molecular Weight: 1135.363
ADL6-D1
1-((2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((S)-2-((S)-2-(6-(2,5-dioxo-2,5-dihydro-1H-pyrrol-1-yl)hexanamido)-3-methylbutanamido)propanamido)benzyl) piperazine-1,4-dicarboxylate TABLE 14-continued Structures of exemplary conjugatable linker-payload (L-D) compounds

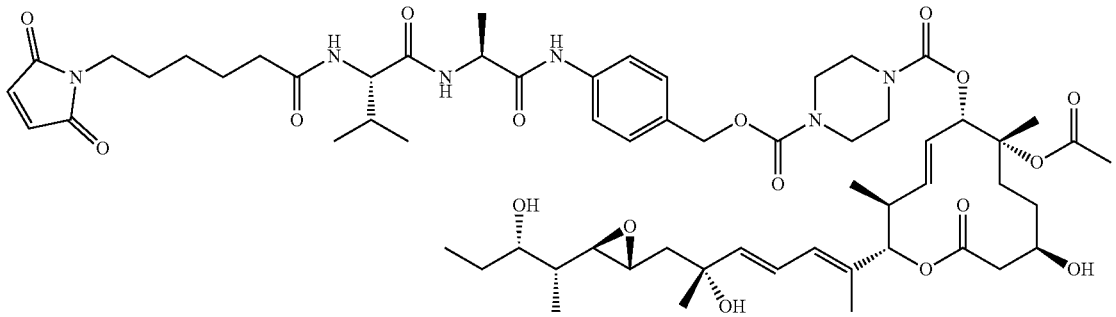

Chemical Formula: $C_{61}H_{88}N_6O_{17}$
Molecular Weight: 1177.400
ADL6-D2
1-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((S)-2-((S)-2-(6-(2,5-dioxo-2,5-dihydro-1H-pyrrol-1-yl)hexanamido)-3-methylbutanamido)propanamido)benzyl) piperazine-1,4-dicarboxylate

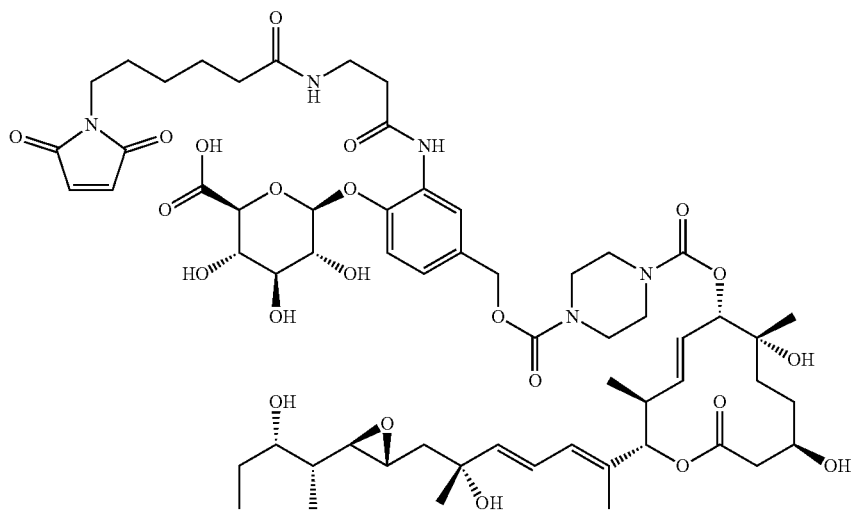

Chemical Formula: $C_{60}H_{85}N_5O_{22}$
Molecular Weight: 1228.353
ADL13-D1
(2S,3S,4S,5R,6S)-6-(4-(((4-(((((2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl)oxy)carbonyl)piperazine-1-carbonyl)oxy)methyl)-2-(3-(6-(2,5-dioxo-2,5-dihydro-1H-pyrrol-1-yl)hexanamido)propanamido)phenoxy)-3,4,5-trihydroxytetrahydro-2H-pyran-2-carboxylic acid TABLE 14-continued Structures of exemplary conjugatable linker-payload (L-D) compounds

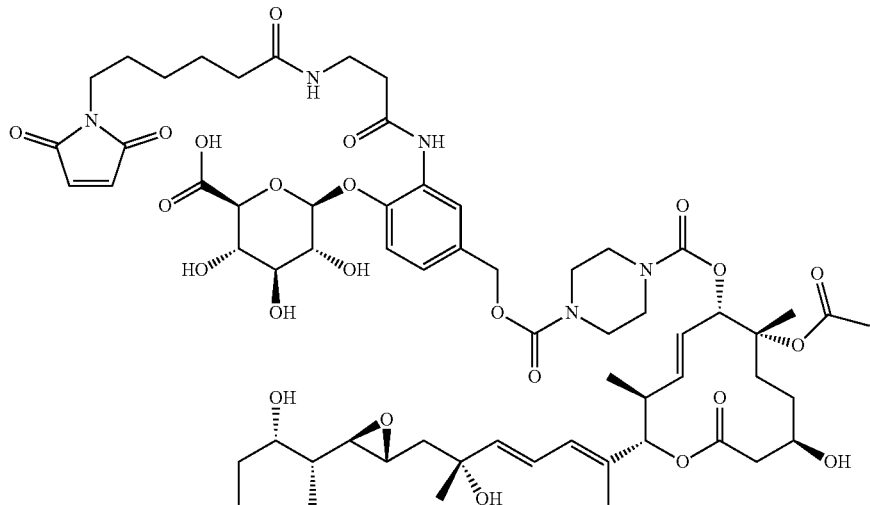

Chemical Formula: $C_{62}H_{87}N_5O_{23}$
Molecular Weight: 1270.390
ADL13-D2
(2S,3S,4S,5R,6S)-6-(4-(((4-(((((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl)oxy)carbonyl)piperazine-1-carbonyl)oxy)methyl)-2-(3-(6-(2,5-dioxo-2,5-dihydro-1H-pyrrol-1-yl)hexanamido

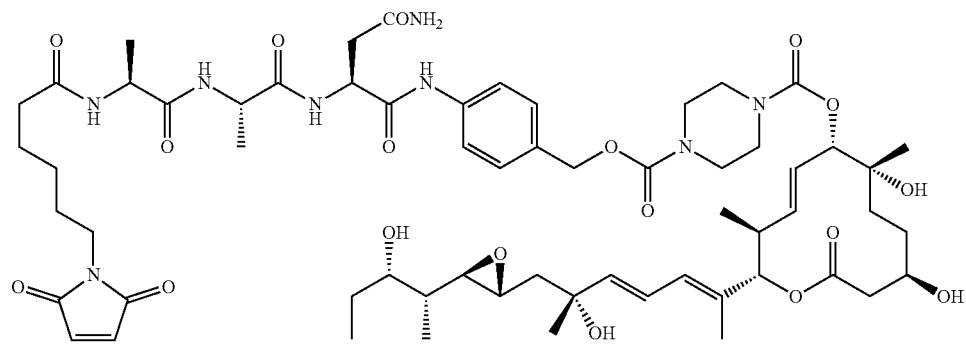

Chemical Formula: $C_{61}H_{88}N_8O_{18}$
Molecular Weight: 1221.41
ADL21-D1
1-(4-((S)-4-amino-2-((S)-2-((S)-2-(6-(2,5-dioxo-2,5-dihydro-1H-pyrrol-1-yl)hexanamido)propanamido)propanamido)-4-oxobutanamido)benzyl) 4-((2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) piperazine-1,4-dicarboxylate TABLE 14-continued Structures of exemplary conjugatable linker-payload (L-D) compounds

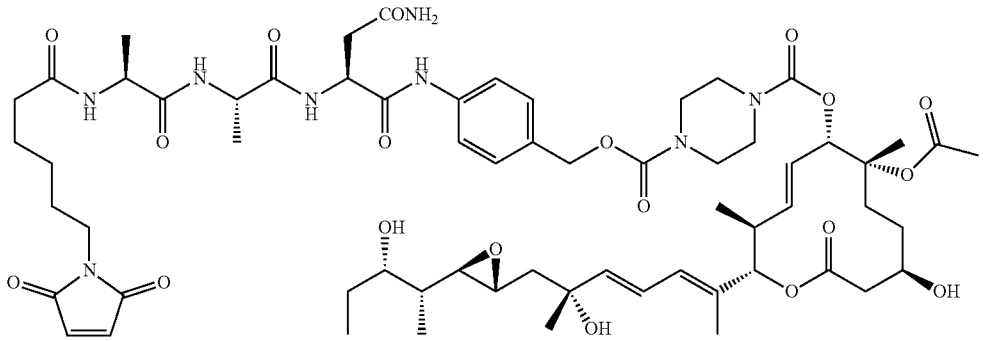

Chemical Formula: $C_{63}H_{90}N_5O_{19}$
Molecular Weight: 1263.45
ADL21-D2
1-((2S,3S,6S,7R,10R,E)-7-acetoxy-10-hydroxy-2-((R,2E,4E)-6-hydroxy-7-((2R,3R)-3-
((2R,3S)-3-hydroxypentan-2-yl)oxiran-2-yl)-6-methylhepta-2,4-dien-2-yl)-3,7-dimethyl-12-
oxooxacyclododec-4-en-6-yl) 4-(4-((S)-4-amino-2-((S)-2-((S)-2-(6-(2,5-dioxo-2,5-dihydro-1H-
pyrrol-1-yl)hexanamido)propanamido)propanamido)-4-oxobutanamido)benzyl) piperazine-1,4-
dicarboxylate

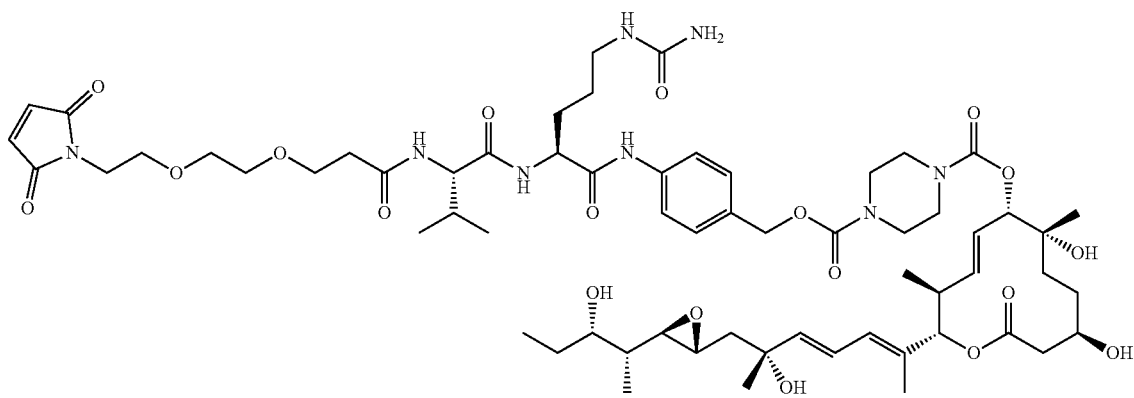

Chemical Formula: $C_{63}H_{94}N_8O_{19}$
Molecular Weight: 1267.482
ADL22-D1
1-((2S,3S,6S,7R,10R,E)-7,10-dihydroxy-2-((R,2E,4E)-6-hydroxy-7-((2R,3R)-3-((2R,3S)-3-
hydroxypentan-2-yl)oxiran-2-yl)-6-methylhepta-2,4-dien-2-yl)-3,7-dimethyl-12-
oxooxacyclododec-4-en-6-yl) 4-(4-((2S,5S)-15-(2,5-dioxo-2,5-dihydro-1H-pyrrol-1-yl)-5-
isopropyl-4,7-dioxo-2-(3-ureidopropyl)-10,13-dioxa-3,6-diazapentadecanamido)benzyl)
piperazine-1,4-dicarboxylate

TABLE 14-continued

Structures of exemplary conjugatable linker-payload (L-D) compounds

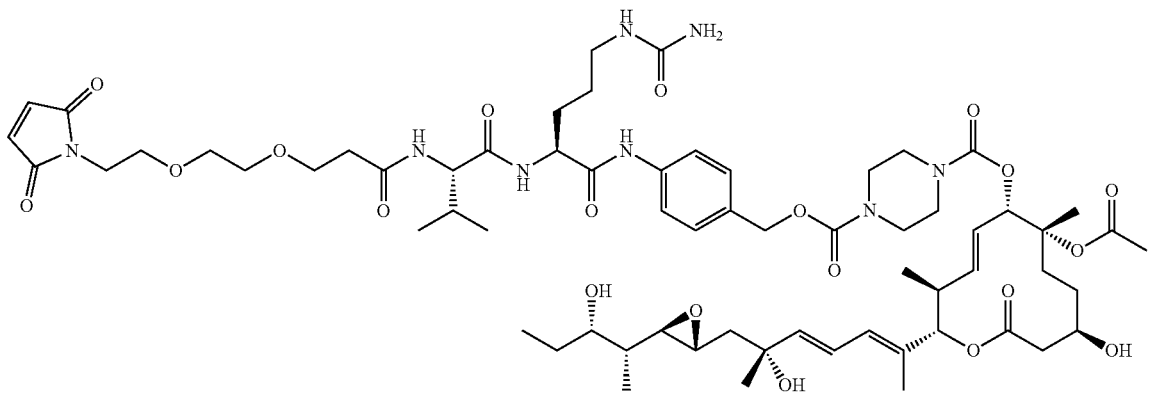

Chemical Formula: $C_{65}H_{96}N_8O_{20}$
Molecular Weight: 1309.52
ADL22-D2
1-((2S,3S,6S,7R,10R,E)-7-acetoxy-10-hydroxy-2-((R,2E,4E)-6-hydroxy-7-((2R,3R)-3-
((2R,3S)-3-hydroxypentan-2-yl)oxiran-2-yl)-6-methylhepta-2,4-dien-2-yl)-3,7-dimethyl-12-
oxooxacyclododec-4-en-6-yl) 4-(4-((2S,5S)-15-(2,5-dioxo-2,5-dihydro-1H-pyrrol-1-yl)-5-
isopropyl-4,7-dioxo-2-(3-ureidopropyl)-10,13-dioxa-3,6-diazapentadecanamido)benzyl)
piperazine-1,4-dicarboxylate

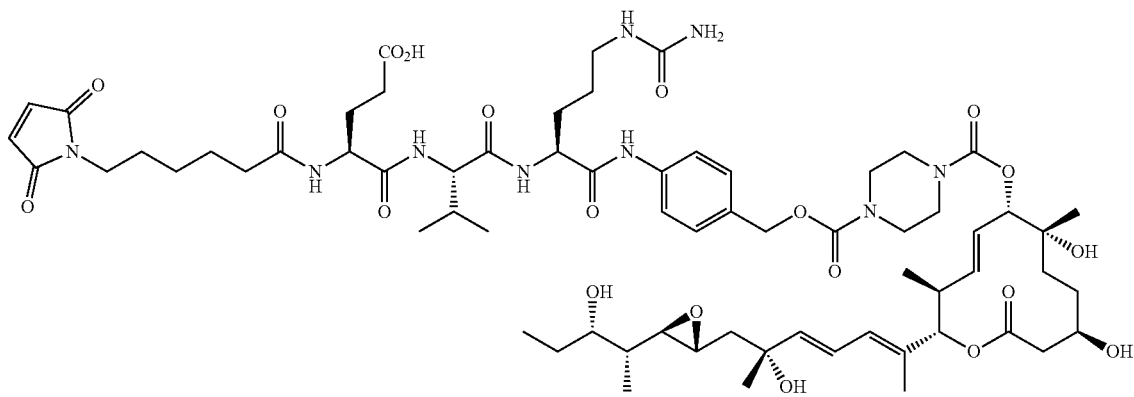

Chemical Formula: $C_{67}H_{99}N_9O_{20}$
Molecular Weight: 1350.572
ADL23-D1
(S)-5-(((S)-1-(((S)-1-((4-(((4-(((((2S,3S,6S,7R,10R,E)-7,10-dihydroxy-2-((R,2E,4E)-6-hydroxy-
7-((2R,3R)-3-((2R,3S)-3-hydroxypentan-2-yl)oxiran-2-yl)-6-methylhepta-2,4-dien-2-yl)-3,7-
dimethyl-12-oxooxacyclododec-4-en-6-yl)oxy)carbonyl)piperazine-1-
carbonyl)oxy)methyl)phenyl)amino)-1-oxo-5-ureidopentan-2-yl)amino)-3-methyl-1-oxobutan-
2-yl)amino)-4-(6-(2,5-dioxo-2,5-dihydro-1H-pyrrol-1-yl)hexanamido)-5-oxopentanoic acid TABLE 14-continued Structures of exemplary conjugatable linker-payload (L-D) compounds

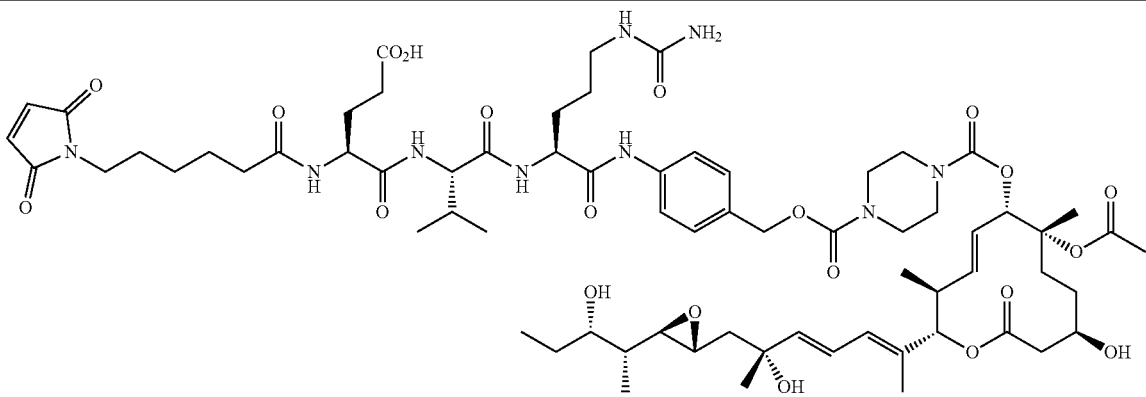

Chemical Formula: $C_{69}H_{101}N_9O_{21}$
Molecular Weight: 1392.609
ADL23-D2
(S)-5-(((S)-1-(((S)-1-((4-(((4-(((((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl)oxy)carbonyl)piperazine-1-carbonyl)oxy)methyl)phenyl)amino)-1-oxo-5-ureidopentan-2-yl)amino)-3-methyl-1-oxobutan-2-yl)amino)-4-(6-(2,5-dioxo-2,5-dihydro-1H-pyrrol-1-yl)hexanamido)-5-oxopentanoic acid 1.2 Overview—General Procedure 1

Scheme 1
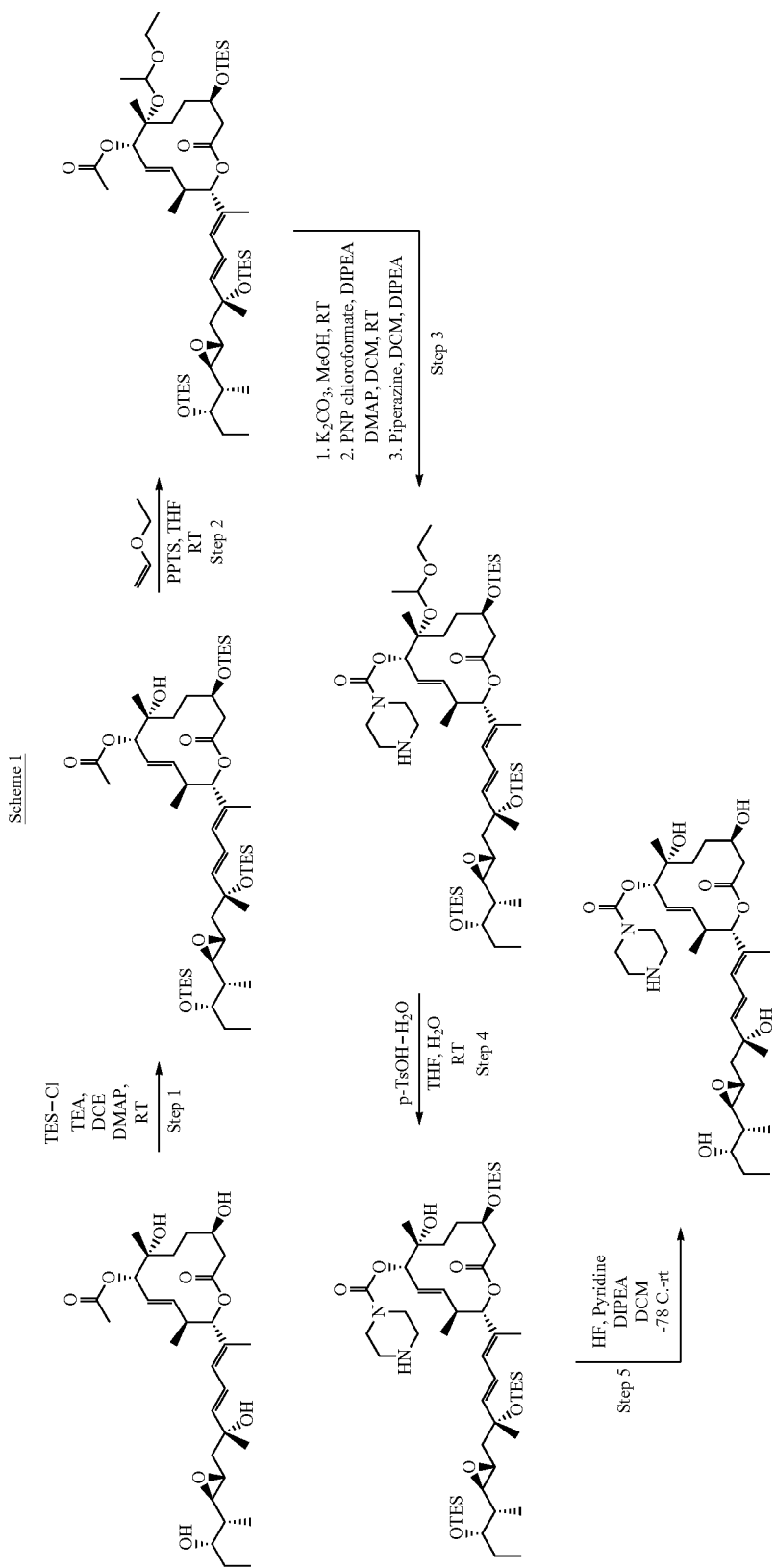

Step 1: (2S,3S,6S,7R,10R,E)-7-hydroxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl acetate To a stirred solution of (2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-ylacetate (1.7 g, 3.2 mmol) in 1,2-dichloroethane (31.5 mL) was added triethylamine (4.40 mL, 31.5 mmol) and DMAP (390 mg, 3.2 mmol) at RT. Chlorotriethylsilane (2.1 mL, 12.6 mmol) was added, and the reaction mixture was stirred for 16 hours. Brine was added, and the reaction mixture was stirred for 30 min. The organic layer was separated, and the aqueous layer was extracted with DCM (3×). The organic layers were combined, dried, filtered, concentrated to dryness, and purified by silica gel chromatography (eluting with 0-100% EtOAc in Hexanes) to afford the titled product. $^1$H-NMR (400 MHz, CDCl$_3$): δ ppm 0.57-0.67 (m, 18H), 0.80-0.90 (m, 10H), 0.93-1.01 (m, 28H), 1.20-1.23 (m, 4H), 1.36-1.42 (m, 4H), 1.43-1.54 (m, 4H), 1.57 (s, 3H), 1.90 (m, 1H), 2.10 (m, 4H), 2.38-2.53 (m, 3H), 2.57 (m, 1H), 2.82-2.87 (m, 1H), 3.74 (m, 1H), 3.81-3.89 (m, 1H), 4.99 (m, 1H), 5.06-5.11 (m, 1H), 5.60-5.75 (m, 3H), 6.11 (m, 1H), 6.42 (m, 1H).

Step 2: (2S,3S,6S,7R,10R,E)-7-((R)-1-ethoxyethoxy)-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl acetate and (2S,3S,6S,7R,10R,E)-7-((S)-1-ethoxyethoxy)-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl acetate To a stirred solution of (2S,3S,6S,7R,10R,E)-7-hydroxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl acetate (4.3 g, 4.8 mmol) in THF (60 mL) was added ethyl vinyl ether (18.4 mL, 192 mmol) followed by PPTS (0.3 g, 1.0 mmol). The reaction mixture was stirred at RT for 15 hours. TEA (0.6 mL) was added, and the mixture was stirred for 5 min at RT. EtOAc (60 mL) and a saturated solution of aqueous NaHCO$_3$ were added to the mixture. The organic layer was separated, dried, filtered, and concentrated in vacuo. The residue was purified by silica gel chromatography (eluting with 0-100% EtOAc in Hexanes) to afford (2S,3S,6S,7R,10R,E)-7-((S)$_1$-ethoxyethoxy)-2-((R,2E,4E)-6-hydroxy-6-methyl-7-((2R,3R)-3-((2S,3S)-3-((triethylsilyl)oxy)pentan-2-yl)oxiran-2-yl)hepta-2,4-dien-2-yl)-3,7-dimethyl-12-oxo-10-((triethylsilyl)oxy)oxacyclododec-4-en-6-yl acetate and (2S,3S,6S,7R,10R,E)-7-((R)$_1$-ethoxyethoxy)-2-((R,2E,4E)-6-hydroxy-6-methyl-7-((2R,3R)-3-((2S,3S)-3-((triethylsilyl)oxy)pentan-2-yl)oxiran-2-yl)hepta-2,4-dien-2-yl)-3,7-dimethyl-12-oxo-10-((triethylsilyl)oxy)oxacyclododec-4-en-6-yl acetate as a mixture of diastereomers. $^1$H-NMR (400 MHz, CD$_3$OD): δ ppm 0.48-0.60 (m, 18H), 0.73-0.94 (m, 37H), 1.10-1.24 (m, 8H), 1.26-1.53 (m, 13H), 1.62-1.70 (m, 3H), 1.82 (m, 1H), 1.96-2.03 (m, 3H), 2.30-2.52 (m, 4H), 2.74-2.79 (m, 1H), 3.41-3.68 (m, 3H), 3.71-3.79 (m, 1H), 4.90-5.12 (m, 3H), 5.51-5.72 (m, 3H), 6.03 (m 1H), 6.34 (m, 1H).

Step 3: (2S,3S,6S,7R,10R,E)-7-((R)-1-ethoxyethoxy)-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl piperazine-1-carboxylate and (2S,3S,6S,7R,10R,E)-7-((S)-1-ethoxyethoxy)-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl piperazine-1-carboxylate To a solution of (2S,3S,6S,7R,E)-7-((R)-1-ethoxyethoxy)-3,7-dimethyl-2-((R,2E,4E)-6-methyl-6-((triethylsilyl)oxy)-7-((2R,3R)-3-((2S,3S)-3-triethylsilyl)oxy)pentan-2-yl)oxiran-2-yl)hepta-2,4-dien-2-yl)-12-oxo-10-((triethylsilyl)oxy)oxacyclododec-4-en-6-yl acetate and (2S,3S,6S,7R,10R,E)-7-((S)$_1$-ethoxyethoxy)-3,7-dimethyl-2-((R,2E,4E)-6-methyl-6-((triethylsilyl)oxy)-7-((2R,3R)-3-((2S,3S)-3-triethylsilyl)oxy)pentan-2-yl)oxiran-2-yl) hepta-2,4-dien-2-yl)-12-oxo-10-((triethylsilyl)oxy) oxacyclododec-4-en-6-yl acetate (2.6 g, 2.6 mmol) in MeOH (25 mL) was added potassium carbonate (0.7 g, 5.3 mmol). The reaction mixture was stirred at RT for 3 hours. The mixture was diluted with EtOAc and washed with water and brine. The organic layer was dried, filtered, and concentrated to dryness. The resulting material (2.45 g, 2.6 mmol) was dissolved in DCM (30 mL). DIPEA (2.3 mL, 13.2 mmol), 4-nitrophenyl chloroformate (1.6 g, 4.0 mmol) and DMAP (0.130 g, 1.1 mmol) were added to the reaction mixture. The reaction mixture was stirred at RT for 6 hours and then diluted with DCM. The mixture was washed with brine, dried, filtered, and concentrated to dryness. The obtained residue was dissolved in DCM (30 mL). DIPEA (2.3 mL, 13.2 mmol) and piperazine (0.7 g, 7.9 mmol) were added, and reaction mixture was stirred at RT for 4 hours. The reaction mixture was diluted with DCM and washed with water and brine. The organic layer was dried, filtered and concentrated to dryness. The obtained residue was purified using NH-silica gel chromatography (ISCO RediSep® amine functionalized column) eluting with 0-10% MeOH in DCM to afford the titled compound as a mixture of diastereomers. $^1$H-NMR (400 MHz, CD$_3$OD): δ ppm 0.57-0.69 (m, 19H) 0.80-1.01 (m, 39H) 1.16-1.41 (m, 15H) 1.44-1.62 (m, 7H) 1.73 (m, 4H) 1.83-1.96 (m, 4H) 2.38-2.61 (m, 4H) 2.78-2.91 (m, 5H) 3.05 (s, 1H) 3.42-3.65 (m, 7H) 3.75 (td, 1H) 3.84 (br s, 1H), 4.97-5.08 (m, 3H), 5.11-5.20 (m, 1H), 5.60-5.79 (m, 3H), 6.12 (br d, 1H), 6.43 (dd, 1H), 6.54 (d, 1H) 8.18-8.29 (m, 1H). LC/MS (ESI, m/z), 1038.7 [M+H]⁺.

Step 4: (2S,3S,6S,7R,10R,E)-7-hydroxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl piperazine-1-carboxylate To a solution of (2S,3S,6S,7R,10R,E)-7-((R)-1-ethoxyethoxy)-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl piperazine-1-carboxylate and (2S,3S,6S,7R,10R,E)-7-((S)-1-ethoxyethoxy)-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl piperazine-1-carboxylate (970 mg, 0.7 mmol) in THF (15 mL) and water (5 mL) was added 4-methylbenzenesulfonic acid hydrate (208 mg, 1.1 mmol). The reaction mixture was stirred at RT for 4 hours and was quenched by addition of a saturated solution of aqueous NaHCO₃. The resulting mixture was extracted with DCM. The combined organic layers were washed with water and brine, then dried, filtered and concentrated to dryness to afford (2S,3S,6S,7R,10R,E)-7-hydroxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-ylpiperazine-1-carboxylate. The material was used in step 5 without further purification. LC/MS (ESI, m/z), 966.3 [M+H]⁺.

Step 5: (2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl piperazine-1-carboxylate To a solution of (2S,3S,6S,7R, 10R,E)-7-hydroxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-ylpiperazine-1-carboxylate (670 mg, 0.69 mmol) in DCM (15 mL) and DIPEA (15 mL, 85.9 mmol) at −78° C. was added hydrogen fluoride-pyridine (CAS Number 62778-11-4, 1.9 mL, 20.8 mmol) dropwise. The reaction mixture was allowed to warm to RT and stirred for 16 hours. The resulting mixture was diluted with DCM and washed with a saturated, aqueous NaHCO₃ solution, water, and brine. The organic layer was dried, filtered, concentrated in vacuo, and purified by NH-silica gel chromatography (ISCO RediSep® amine functionalized column) and HPLC purification to afford (2S,3S,6S,7R,10R, E)-7,10-di hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl piperazine-1-carboxylate. ¹H-NMR (400 MHz, CDCl₃): δ ppm 0.86-0.93 (m, 6H), 0.94-0.99 (t, 3H), 1.24 (s, 3H), 1.26-1.44 (m, 7H), 1.47-1.65 (m, 5H), 1.66-1.79 (m, 7H), 1.82 (br d, 3H), 2.45-2.67 (m, 4H), 2.76 (dd, 1H), 2.88 (br d, 3H), 2.94-3.04 (m, 1H), 3.66 (br d, 1H), 3.72-3.82 (m, 1H), 5.00-5.06 (m, 1H), 5.17 (d, 1H), 5.57-5.77 (m, 2H), 5.85 (d, 1H), 6.12 (br d, 1H), 6.53 (dd, 1H). LC/MS (ESI, m/z), 623.6 [M+H]⁺.

1.3 ADL1-D1

Synthesis of 1-((2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((S)-2-((S)-2-(6-(2,5-dioxo-2,5-dihydro-1H-pyrrol-1-yl) hexanamido)-3-methylbutanamido)-5-ureidopentanamido)benzyl) piperazine-1,4-dicarboxylate (ADL1-D1)

Scheme 2

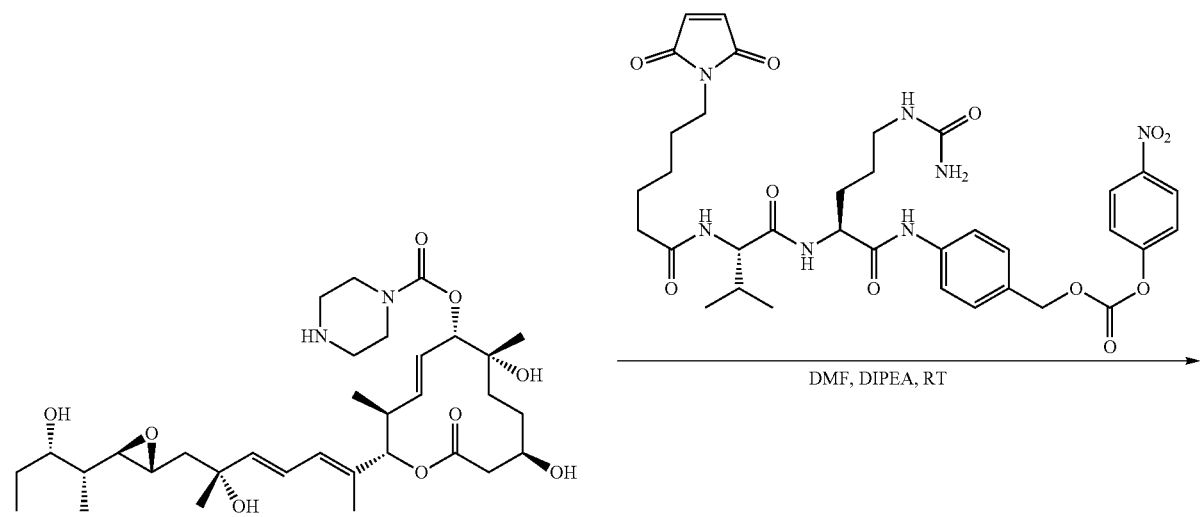

-continued

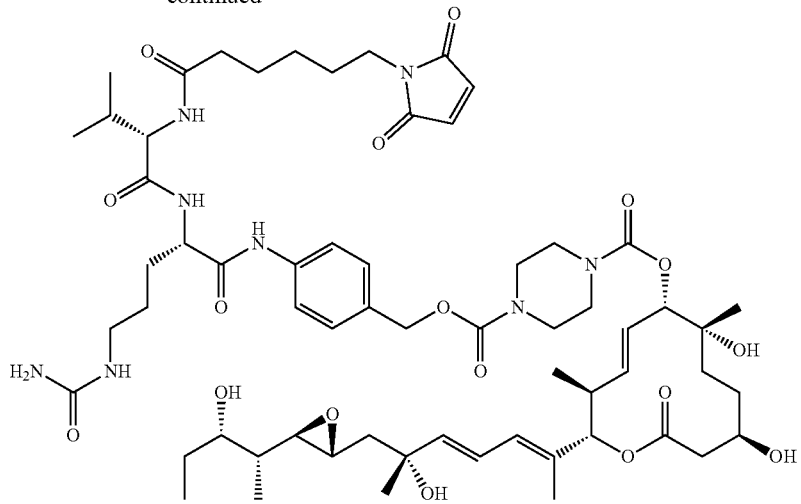

To a stirred solution of (2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-ylpiperazine-1-carboxylate (177 mg, 0.28 mmol) in DMF (2 mL) was added DIPEA (50 μL, 0.27 mmol) followed by 4-((S)-2-((S)-2-(6-(2,5-dioxo-2,5-dihydro-1H-pyrrol-1-yl)hexanamido)-3-methylbutanamido)-5-ureidopentanamido)benzyl (4-nitrophenyl) carbonate (200 mg, 0.27 mmol). The reaction mixture was stirred at RT for 2 hours. The resulting mixture was concentrated to dryness and purified by preparative HPLC to afford the titled compound. $^1$H-NMR (400 MHz, CD$_3$OD): δ ppm 0.86-1.04 (m, 16H), 1.22-1.42 (m, 7H), 1.45-1.71 (m, 12H), 1.75-1.82 (m, 4H), 1.84-1.97 (m, 2H), 2.04-2.14 (m, 1H), 2.29 (m, 2H), 2.49-2.64 (m, 3H), 2.69 (m, 1H), 2.92 (m, 1H), 3.09-3.30 (m, 3H), 3.35-3.41 (m, 1H), 3.41-3.61 (m, 10H), 3.68-3.84 (m, 1H), 4.16-4.21 (m, 1H), 4.52 (dd, 1H), 4.86-4.99 (m, 1H) 5.06-5.13 (m, 3H), 5.60 (dd, 1H), 5.74 (dd, 1H), 5.89 (d, 1H), 6.15 (d, 1H), 6.55 (dd, 1H), 6.80 (s, 2H), 7.34 (m, 2H), 7.60 (m, 2H). LC/MS (ESI, m/z), 1222.6 [M+H]$^+$.

1.4 ADL1-D2

Synthesis of 1-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((S)-2-((S)-2-(6-(2,5-dioxo-2,5-dihydro-1H-pyrrol-1-yl)hexanamido)-3-methylbutanamido)-5-ureidopentanamido)benzyl) piperazine-1,4-dicarboxylate (ADL1-D2)

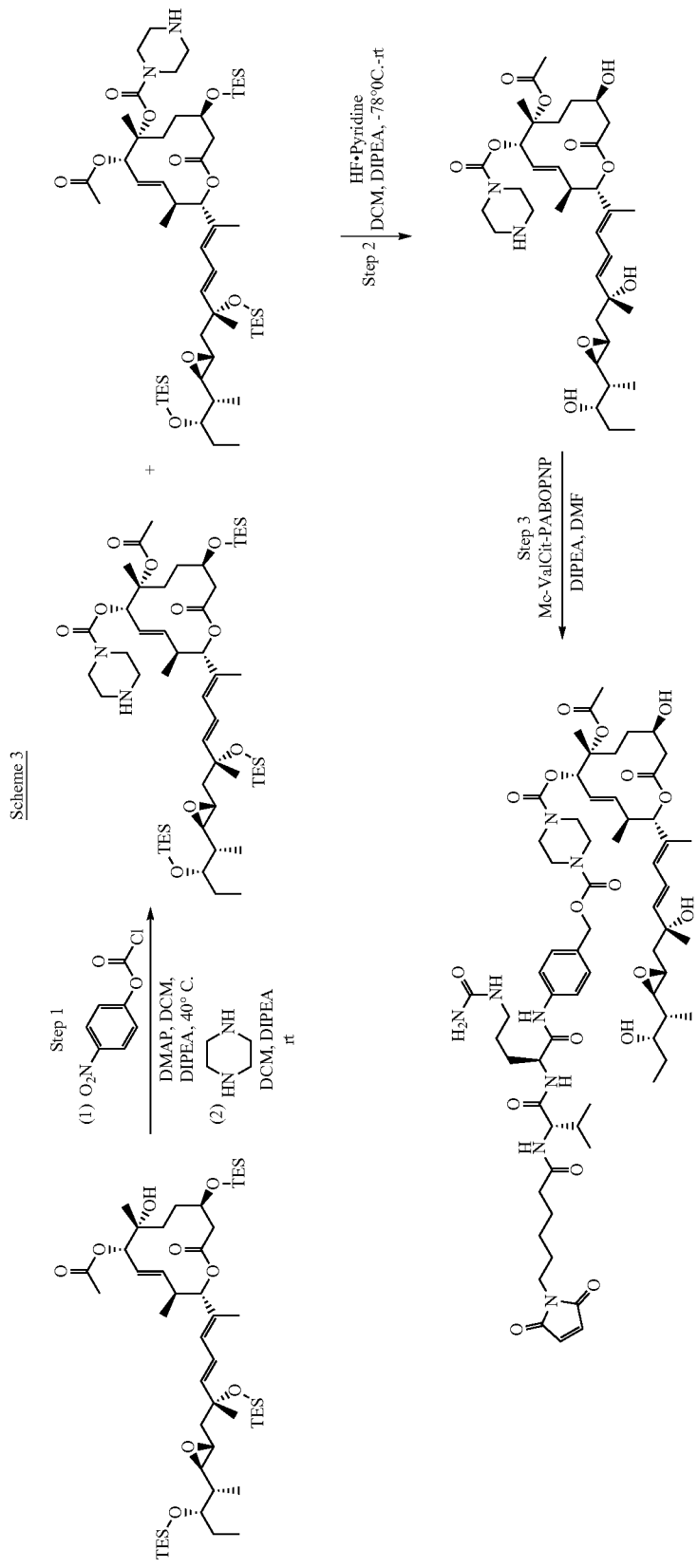
Scheme 3

Step 1: (2S,3S,6S,7R,10R,E)-7-acetoxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl piperazine-1-carboxylate and (2S,3S,6S,7R,10R,E)-6-acetoxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-7-yl piperazine-1-carboxylate To a solution of (2S,3S,6S,7R,10R,E)-7-hydroxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl acetate (160 mg, 0.18 mmol) in 1,2-dichloroethane (5 mL) at 20° C. was added DMAP (32.7 mg, 0.27 mmol), triethylamine (0.75 mL, 5.36 mmol), and 4-nitrophenyl chloroformate (360 mg, 1.79 mmol). The reaction mixture was stirred at 40° C. for 4 days followed by 60° C. for 2 hours. The reaction mixture was then diluted with EtOAc and washed with water. The aqueous layer was extracted with EtOAc (2×). The combined organic extracts were successively washed with water and brine, dried over anhydrous MgSO$_4$, filtered, and concentrated in vacuo. The residue was purified by silica gel chromatography (eluting with 0-100% EtOAc in Hexanes) to furnish (2S,3S,6S,7R,10R,E)-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-6-(((4-nitrophenoxy)carbonyl)oxy)-12-oxo-10-((triethylsilyl)oxy)oxacyclododec-4-en-7-yl acetate and (2S,3S,6S,7R,10R,E)-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-7-(((4-nitrophenoxy)carbonyl)oxy)-12-oxo-10-((triethylsilyl)oxy)oxacyclododec-4-en-6-yl acetate as a mixture of regioisomers.

To a stirred solution of (2S,3S,6S,7R,10R,E)-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-6-(((4-nitrophenoxy)carbonyl)oxy)-12-oxo-10-((triethylsilyl)oxy)oxacyclododec-4-en-7-yl acetate and (2S,3S,6S,7R,10R,E)-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-7-(((4-nitrophenoxy)carbonyl)oxy)-12-oxo-10-((triethylsilyl)oxy)oxacyclododec-4-en-6-yl acetate in DCM (1.0 mL) was added piperazine (0.447 g, 5.20 mmol) and DIPEA (0.9 mL, 5.20 mmol). The resulting yellowish suspension was stirred at RT for 6 hours. The resulting mixture was concentrated in vacuo and purified by silica gel chromatography (eluting with 0-10% MeOH in DCM) to furnish (2S,3S,6S,7R,10R,E)-7-acetoxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl piperazine-1-carboxylate and (2S,3S,6S,7R,10R,E)-6-acetoxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-7-yl piperazine-1-carboxylate as a mixture of regioisomers. LC/MS (ESI, m/z), 1008.1 [M+H]$^+$.

Step 2: (2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-ylpiperazine-1-carboxylate To a stirred solution of (2S,3S,6S,7R,10R,E)-7-acetoxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-6-yl piperazine-1-carboxylate and (2S,3S,6S,7R,10R,E)-6-acetoxy-3,7-dimethyl-2-((R,2E,4E)-6-methyl-6-((triethylsilyl)oxy)-7-((2R,3R)-3-((2S,3S)-3-((triethylsilyl)oxy)pentan-2-yl)oxiran-2-yl)hepta-2,4-dien-2-yl)-12-oxo-10-((triethylsilyl)oxy)oxacyclododec-4-en-7-yl piperazine-1-carboxylate (1.09 g, 0.92 mmol) in DCM (21.0 mL) was added DIPEA (19.9 mL, 114.0 mmol). The reaction mixture was cooled to −78° C. Hydrogen fluoride-pyridine (CAS Number 62778-11-4, 0.518 g, 5.23 mmol) was added to the reaction mixture, then the reaction mixture was allowed to warm to RT and stirred overnight. The resulting mixture was cooled in an ice bath and a saturated aqueous solution of NaHCO$_3$ was added. The reaction mixture was extracted with DCM and the organic layer was dried, filtered, and concentrated in vacuo. The resultant product was subjected to HPLC purification to furnish (2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl piperazine-1-carboxylate. $^1$H-NMR (400 MHz, CD$_3$OD): δ ppm 0.87-0.92 (m, 6H), 0.94 (t, 3H), 1.16-1.31 (m, 1H), 1.35 (s, 3H), 1.40-1.56 (m, 4H), 1.59 (s, 3H), 1.66 (m, 3H), 1.76-1.80 (m, 3H), 1.87 (m, 1H), 2.05 (s, 3H), 2.30-2.41 (m, 1H), 2.50 (d, 2H), 2.56-2.72 (m, 2H), 2.90 (td, 1H), 3.19 (m, 4H), 3.50-3.59 (m, 1H), 3.71 (br s, 4H), 3.77-3.89 (m, 1H), 5.05 (dd, 2H), 5.65 (dd, 1H), 5.76 (dd, 1H), 5.88 (d, 1H), 6.14 (d, 1H), 6.53 (dd, 1H). LC/MS (ESI, m/z), 665.6 [M+H]$^+$.

Step 3: 1-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((S)-2-((S)-2-(6-(2,5-dioxo-2,5-dihydro-1H-pyrrol-1-yl)hexanamido)-3-methylbutanamido)-5-ureidopentanamido)benzyl) piperazine-1,4-dicarboxylate (ADL1-D2)

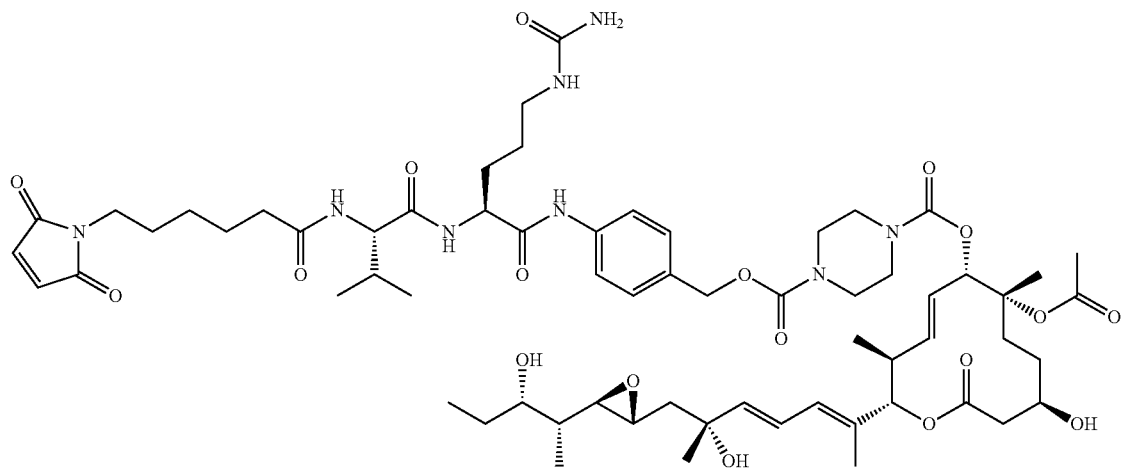 [SMILES: CC[C@H](O)[C@@H](C)[C@H]1O[C@@H]1C[C@@](C)(O)/C=C/C=C(\C)[C@H]1OC(=O)C[C@H](O)CC[C@@](C)(OC(C)=O)[C@@H](OC(=O)N2CCN(C(=O)OCc3ccc(NC(=O)[C@H](CCCNC(N)=O)NC(=O)[C@@H](NC(=O)CCCCCN4C(=O)C=CC4=O)C(C)C)cc3)CC2)/C=C/[C@@H]1C]

The titled compound was prepared employing the procedure described in section 1.3 using (2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-ylpiperazine-1-carboxylate as the starting material. $^1$H-NMR (400 MHz, CD$_3$OD): δ ppm 0.83-1.03 (m, 15H) 1.20-1.38 (m, 7H) 1.40-1.70 (m, 15H) 1.71-1.81 (m, 4H) 1.83-1.96 (m, 2H) 2.01-2.14 (m, 4H) 2.27 (t, 2H) 2.32-2.43 (m, 1H) 2.47-2.53 (m, 2H) 2.55-2.65 (m, 1H) 2.67 (dd, 1H) 2.87-2.94 (m, 1H) 3.05-3.25 (m, 2H) 3.43-3.55 (m, 11H) 3.73-3.85 (m, 1H) 4.11-4.21 (m, 1H) 4.46-4.53 (m, 1H) 4.53-4.60 (m, 1H) 5.05 (dd, 2H) 5.09 (s, 2H) 5.49 (s, 1H) 5.64 (dd, 1H) 5.76 (dd, 1H) 5.87 (d, 1H) 6.15 (d, 1H) 6.53 (dd, 1H) 6.79 (s, 2H) 7.32 (d, 2H) 7.58 (d, 2H). LC/MS (ESI, m/z), 1263.8 [M+H]$^+$.

1.5 ADL22-D1

Synthesis of 1-((2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((2S,5S)-15-(2,5-dioxo-2,5-dihydro-1H-pyrrol-1-yl)-5-isopropyl-4,7-dioxo-2-(3-ureidopropyl)-10,13-dioxa-3,6-diazapentadecanamido)benzyl) piperazine-1,4-dicarboxylate (ADL22-D1)

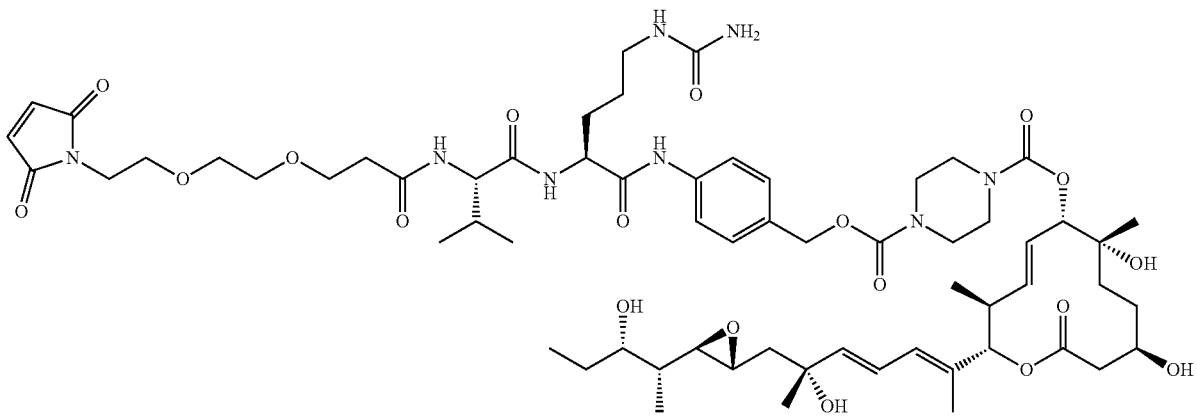 [SMILES: CC[C@H](O)[C@@H](C)[C@H]1O[C@@H]1C[C@@](C)(O)/C=C/C=C(\C)[C@H]1OC(=O)C[C@H](O)CC[C@@](C)(O)[C@@H](OC(=O)N2CCN(C(=O)OCc3ccc(NC(=O)[C@H](CCCNC(N)=O)NC(=O)[C@@H](NC(=O)CCOCCOCCN4C(=O)C=CC4=O)C(C)C)cc3)CC2)/C=C/[C@@H]1C]

To a stirred solution of (2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-ylpiperazine-1-carboxylate (14.2 mg, 0.023 mmol) and 4-((2S,5S)-15-(2,5-dioxo-2,5-dihydro-1H-pyrrol-1-yl)-5-isopropyl-4,7-dioxo-2-(3-ureidopropyl)-10,13-dioxa-3,6-diazapentadecanamido)benzyl (4-nitrophenyl) carbonate (17.9 mg, 0.023 mmol) in DMF (1 mL) was added DIPEA (8 µL, 0.046 mmol). The reaction mixture was stirred at RT for 2 hours. The resulting mixture was purified via reverse phase flash chromatography ($C_{18}$, $H_2O$/acetonitrile/formic acid=95/5/0.1 to 0/100/0.1) to afford the titled compound. $^1$H-NMR (400 MHz, $CD_3OD$): δ 0.86-1.07 (m, 17H), 1.17-1.32 (m, 5H), 1.34-1.43 (m, 5H), 1.47-1.70 (m, 8H), 1.74-1.81 (m, 4H), 1.85-1.98 (m, 2H), 2.08-2.17 (m, 1H), 2.50-2.63 (m, 5H), 2.69 (m, 1H), 2.88-2.94 (m, 1H), 3.10-3.31 (m, 3H), 3.43 (m, 1H), 3.48-3.76 (m, 19H), 3.77-3.83 (m, 1H), 4.20-4.24 (m, 1H), 4.49-4.55 (m, 1H), 4.84-4.87 (m, 2H), 4.90-4.99 (m, 3H), 5.06-5.14 (m, 3H), 5.60 (dd, 1H), 5.74 (dd, 1H), 5.89 (d, 1H), 6.16 (d, 1H), 6.55 (dd, 1H), 6.83 (s, 2H), 7.35 (m, 2H), 7.63 (m, 2H), 8.01 (d, 1H), 8.25 (m, 1H). LC/MS (ESI, m/z), 1263.8 [M+H]$^+$.

1.6 ADL22-D2

Synthesis of 1-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((2S,5S)-15-(2,5-dioxo-2,5-dihydro-1H-pyrrol-1-yl)-5-isopropyl-4,7-dioxo-2-(3-ureidopropyl)-10,13-dioxa-3,6-diazapentadecanamido)benzyl) piperazine-1,4-dicarboxylate (ADL22-D2)

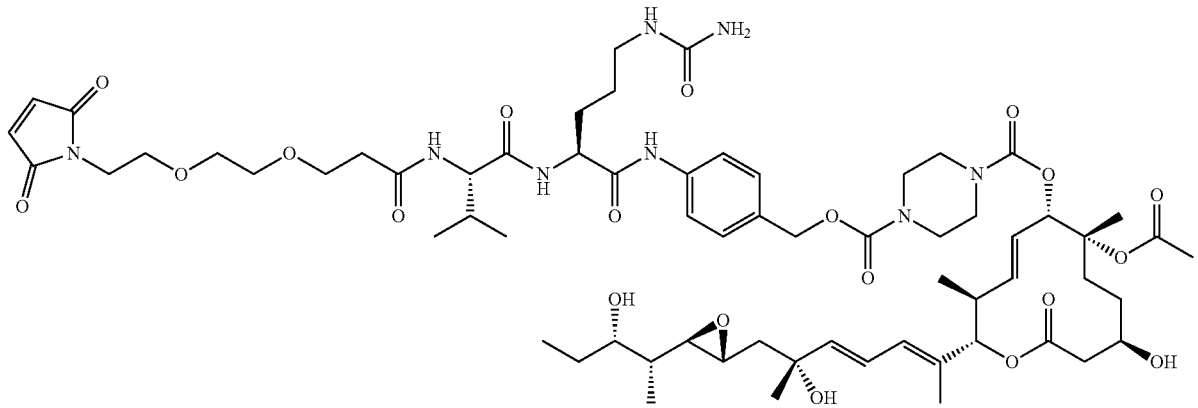 [SMILES: CC[C@H](O)[C@@H](C)[C@H]1O[C@@H]1C[C@@](C)(O)/C=C/C=C(\C)[C@H]1OC(=O)C[C@H](O)CC[C@@](C)(OC(C)=O)[C@@H](OC(=O)N2CCN(C(=O)OCc3ccc(NC(=O)[C@H](CCCNC(N)=O)NC(=O)[C@@H](NC(=O)CCOCCOCCN4C(=O)C=CC4=O)C(C)C)cc3)CC2)/C=C/[C@@H]1C]

To a stirred solution of (2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-ylpiperazine-1-carboxylate (12 mg, 0.018 mmol) in DMF (2 mL) was added 4-((2S,5S)-15-(2,5-dioxo-2,5-dihydro-1H-pyrrol-1-yl)-5-isopropyl-4,7-dioxo-2-(3-ureidopropyl)-10,13-dioxa-3,6-diazapentadecanamido)benzyl (4-nitrophenyl) carbonate (17 mg, 0.022 mmol) and DIPEA (9.4 µL, 0.054 mmol). The reaction mixture was stirred for 1 hour at RT. The resulting mixture was concentrated in vacuo directly on to silica gel and purified by silica gel chromatography eluting with 0-20% MeOH in DCM to afford the titled compound. $^1$H NMR (400 MHz, DMSO-$d_6$) δ ppm 0.73-0.89 (m, 17H), 1.03-1.13 (m, 1H), 1.21-1.25 (m, 4H), 1.25-1.40 (m, 5H), 1.42-1.47 (m, 4H), 1.48, (br s, 3H), 1.69 (s, 4H), 1.73-1.83 (m, 1H), 1.99 (s, 2H), 2.10-2.25 (m, 1H), 2.36 (br s, 3H), 2.40-2.48 (m, 2H), 2.54-2.66 (m, 2H), 2.72-2.80, (m, 1H), 2.88-3.08 (m, 2H), 3.34-3.44 (m, 9H), 3.44-3.48 (m, 3H), 3.48-3.52 (m, 2H), 3.52-3.59 (m, 3H), 3.64-3.75 (m, 1H), 4.24 (s, 1H), 4.40 (m, 2H), 4.62 (m, 1H), 4.80-4.85 (m, 1H), 4.90 (m, 2H), 5.01 (s, 2H), 5.40 (s, 2H), 5.48-5.57 (m, 1H), 5.66-5.76 (m, 1H), 5.81-5.91 (m, 1H), 5.94-6.01 (m, 1H), 6.02-6.11 (m, 1H), 6.36-6.45 (m, 1H), 7.02 (s, 2H), 7.27-7.33 (m, 2H), 7.58 (s, 2H), 7.81-7.89 (m, 1H), 8.11 (m, 1H), 9.96-10.02 (m, 1H). LC/MS (ESI, m/z), 1310.2 [M+H]$^+$.

1.7 ADL6-D2

Synthesis of 1-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((S)-2-((S)-2-(6-(2,5-dioxo-2,5-dihydro-1H-pyrrol-1-yl)hexanamido)-3-methylbutanamido)propanamido)benzyl) piperazine-1,4-dicarboxylate (ADL6-D2)

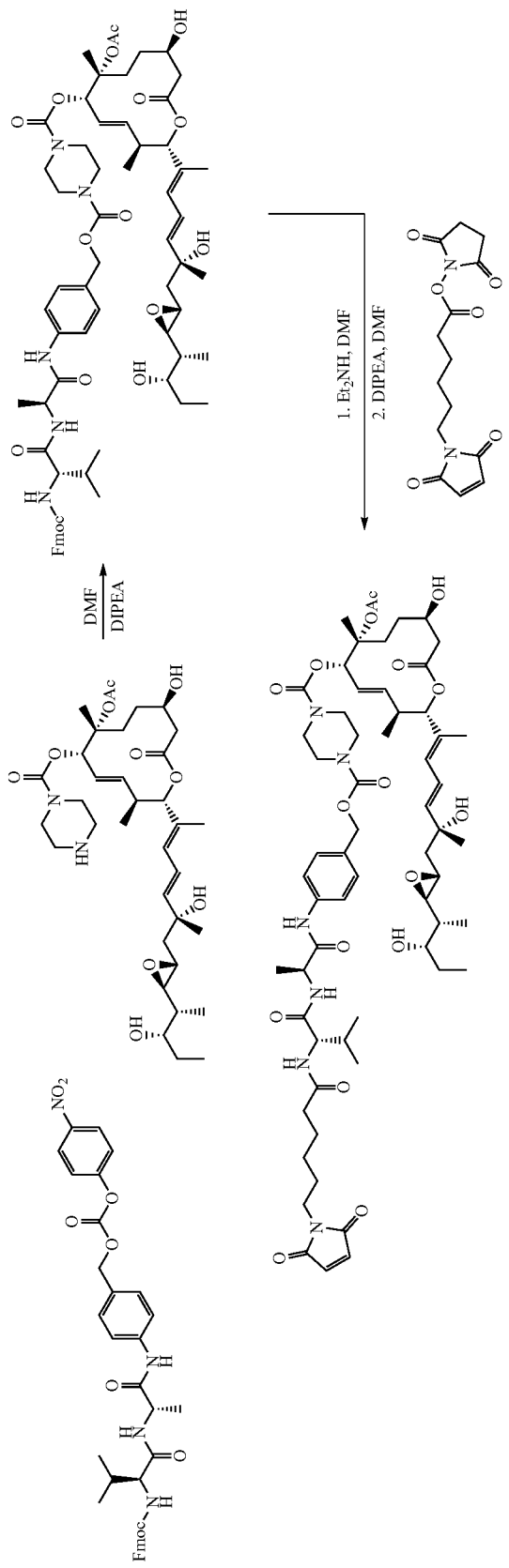

Step 1: 1-(4-((S)-2-((S)-2-((((9H-fluoren-9-yl)methoxy)carbonyl)amino)-3-methylbutanamido)propanamido)benzyl) 4-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) piperazine-1,4-dicarboxylate To a stirred solution of (2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-ylpiperazine-1-carboxylate (35 mg, 0.053 mmol) and (9H-fluoren-9-yl)methyl ((S)-3-methyl-1-(((S)-1-((4-(((((4-nitrophenoxy)carbonyl)oxy)methyl)phenyl)amino)-1-oxopropan-2-yl)amino)-1-oxobutan-2-yl)carbamate (43 mg, 0.06 mmol) in DMF (530 µL) was added DIPEA (28 µL, 0.16 mmol). The reaction mixture was stirred at RT for 30 min and then concentrated in vacuo and then dry loaded onto silica gel. The residue was purified by silica gel chromatography to afford 1-(4-((S)-2-((S)-2-((((9H-fluoren-9-yl)methoxy)carbonyl)amino)-3-methylbutanamido)propanamido)benzyl) 4-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) piperazine-1,4-dicarboxylate. LC/MS (ESI, m/z), 1228.0 [M+Na]+.

Step 2: ADL6-D2

To a stirred solution of 1-(4-((S)-2-((S)-2-((((9H-fluoren-9-yl)methoxy)carbonyl)amino)-3-methylbutanamido)propanamido)benzyl) 4-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) piperazine-1,4-dicarboxylate (45 mg, 0.04 mmol) in DMF (1.4 mL) was added diethylamine (195 µL, 1.86 mmol). The reaction mixture was stirred for 30 min, diluted with ethyl acetate, and concentrated in vacuo to remove excess diethylamine. The residue was dissolved in DMF (1.4 mL) and 2,5-dioxopyrrolidin-1-yl 6-(2,5-dioxo-2,5-dihydro-1H-pyrrol-1-yl)hexanoate (17 mg, 0.06 mmol) was added to the reaction mixture followed by DIPEA (10 µL, 0.06 mmol). The reaction mixture was stirred at RT for 16 hours. The resulting mixture was concentrated in vacuo and then dry loaded onto silica gel. The residue was purified by silica gel column chromatography eluting with 0-15% MeOH in DCM to furnish the titled compound. $^1$H NMR (400 MHz, DMSO-$d_6$) δ ppm 0.77 (d, 3H), 0.79-0.89 (m, 15H), 1.04-1.13 (m, 2H), 1.15-1.20 (m, 5H), 1.22 (s, 3H), 1.24-1.26 (m, 2H), 1.30 (m, 4H), 1.32-1.39 (m, 2H), 1.45 (s, 5H), 1.47-1.62 (m, 5H), 1.67-1.71 (m, 3H), 1.75-1.82 (m, 1H), 1.90-1.99 (m, 4H), 1.99-2.02 (m, 3H), 2.06-2.25 (m, 3H), 2.30-2.41 (m, 2H), 2.59 (s, 2H), 2.71-2.80 (m, 1H), 3.64-3.74 (m, 2H), 4.03 (m, 2H), 4.16 (m, 1H), 4.32-4.46 (m, 2H), 4.79-4.97 (m, 2H), 5.01 (s, 2H), 5.52 (m, 1H), 5.64-5.77 (m, 1H), 5.85 (m, 1H), 6.00-6.09 (m, 1H), 6.41 (m, 1H), 7.00 (s, 2H), 7.30 (m, 2H), 7.58 (d, 2H), 7.80 (d, 1H), 8.15 (d, 1H). LC/MS (ESI, m/z), 1200.4 [M+Na]+.

1.8 ADL21-D2

Synthesis of 1-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((R)-4-amino-2-((R)-2-((S)-2-(6-(2,5-dioxo-2,5-dihydro-1H-pyrrol-1-yl)hexanamido)propanamido)propanamido)-4-oxobutanamido)benzyl) piperazine-1,4-dicarboxylate (ADL21-D2)

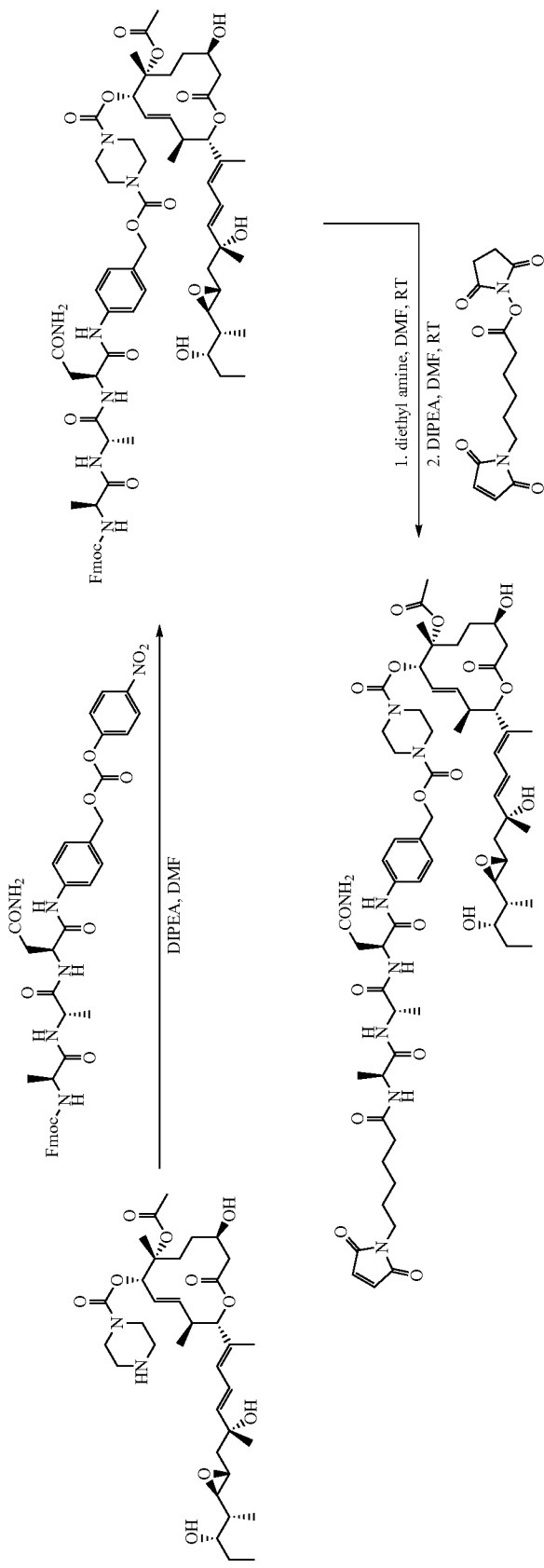

Step 1: 1-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((5S,8S,11S)-11-(2-amino-2-oxoethyl)-1-(9H-fluoren-9-yl)-5,8-dimethyl-3,6,9-trioxo-2-oxa-4,7,10-triazadodecan-12-amido)benzyl) piperazine-1,4-dicarboxylate To a stirred solution of (2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl piperazine-1-carboxylate (75 mg, 0.11 mmol) in DMF (1.1 mL) was added (9H-fluoren-9-yl)methyl((S)-1-(((S)-1-(((S)-4-amino-1-((4-((((4 nitrophenoxy)carbonyl)oxy)methyl)phenyl)amino)-1,4-dioxobutan-2-yl)amino)-1-oxopropan-2-yl)amino)-1-oxopropan-2-yl)carbamate (86 mg, 0.11 mmol) and DIPEA (59 µL, 0.34 mmol). The reaction mixture was stirred at RT for 90 min. The reaction mixture was concentrated in vacuo and purified by silica gel chromatography eluting with 0-15% MeOH in DCM to afford 1-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((5S,8S,11S)-11-(2-amino-2-oxoethyl)-1-(9H-fluoren-9-yl)-5,8-dimethyl-3,6,9-trioxo-2-oxa-4,7,10-triazadodecan-12-amido)benzyl) piperazine-1,4-dicarboxylate. LC/MS (ESI, m/z), 1293.4 [M+H]$^+$.

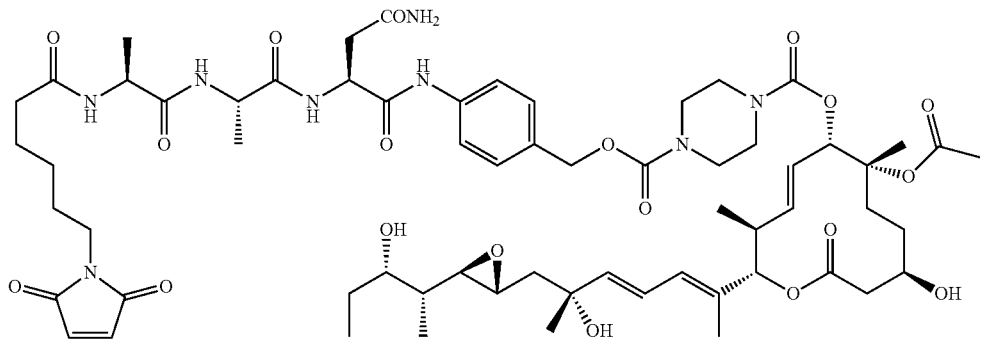 [SMILES: CC[C@H](O)[C@@H](C)[C@H]1O[C@@H]1C[C@@](C)(O)/C=C/C=C(\C)[C@H]1OC(=O)C[C@H](O)CC[C@@](C)(OC(C)=O)[C@@H](OC(=O)N2CCN(C(=O)OCc3ccc(NC(=O)[C@H](CC(N)=O)NC(=O)[C@H](C)NC(=O)[C@H](C)NC(=O)CCCCCN4C(=O)C=CC4=O)cc3)CC2)/C=C/[C@@H]1C]

Steps 2 and 3: 1-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((S)-4-amino-2-((S)-2-((S)-2-(6-(2,5-dioxo-2,5-dihydro-1H-pyrrol-1-yl)hexanamido)propanamido)propanamido)-4-oxobutanamido)benzyl) piperazine-1,4-dicarboxylate To a stirred solution of 1-((2S,3S,6S,7R,10R,E)-7-acetoxy-10-hydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) 4-(4-((5S,8R,11R)-11-(2-amino-2-oxoethyl)-1-(9H-fluoren-9-yl)-5,8-dimethyl-3,6,9-trioxo-2-oxa-4,7,10-triazadodecan-12-amido)benzyl) piperazine-1,4-dicarboxylate (125 mg, 0.097 mmol) in DMF (1.9 mL) was added diethylamine (202 µL, 1.934 mmol). The reaction mixture was stirred at RT for 1 hour. The reaction mixture was diluted with ethyl acetate and concentrated to remove excess diethylamine. The resultant product was dissolved in DMF (1.9 mL) and 2,5-dioxopyrrolidin-1-yl-6-(2,5-dioxo-2,5-dihydro-1H-pyrrol-1-yl)hexanoate (36 mg, 0.12 mmol) and DIPEA (42 µL, 0.24 mmol) was added to the reaction mixture and stirred at RT for 1 hour. The reaction mixture was concentrated and purified by silica gel column chromatography eluting with 0-15% MeOH/DCM to afford the titled compound. $^1$H NMR (400 MHz, DMSO-d$_6$) δ ppm 0.71-0.87 (m, 9H), 1.04-1.12 (m, 1H), 1.14-1.26 (m, 13H), 1.27-1.40 (m, 3H), 1.40-1.52 (m, 9H), 1.52-1.62 (m, 1H), 1.69 (s, 3H), 1.74-1.83 (m, 1H), 1.99 (m, 4H), 2.03-2.14 (m, 2H), 2.15-2.26 (m, 1H), 2.31-2.41 (m, 2H), 2.54-2.65 (m, 4H), 2.72-2.80 (m, 1H), 3.17 (d, 3H), 3.63-3.74 (m, 1H), 3.99-4.12 (m, 2H), 4.14-4.22 (m, 1H), 4.23-4.30 (m, 1H), 4.40 (d, 1H), 4.55-4.65 (m, 2H), 4.82 (s, 1H), 4.87-4.93 (m, 2H), 5.01 (s, 2H), 5.47-5.57 (m, 1H), 5.66-5.77 (m, 1H), 6.01-6.09 (m, 1H), 6.35-6.45 (m, 1H), 6.89-6.96 (m, 1H), 6.99 (s, 2H), 7.30 (m, 2H), 7.36-7.42 (m, 1H), 7.62 (m, 2H), 7.97-8.21 (m, 3H), 9.62-9.72 (m, 1H). LC/MS (ESI, m/z), 1285.0 [M+Na]$^+$.

1.9 ADL21-D1

Synthesis of 1-(4-(((S)-4-amino-2-(((S)-2-(((S)-2-(6-(2,5-dioxo-2,5-dihydro-1H-pyrrol-1-yl)hexanamido)propanamido)propanamido)-4-oxobutanamido)benzyl) 4-(((2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl) piperazine-1,4-dicarboxylate (ADL21-D1)

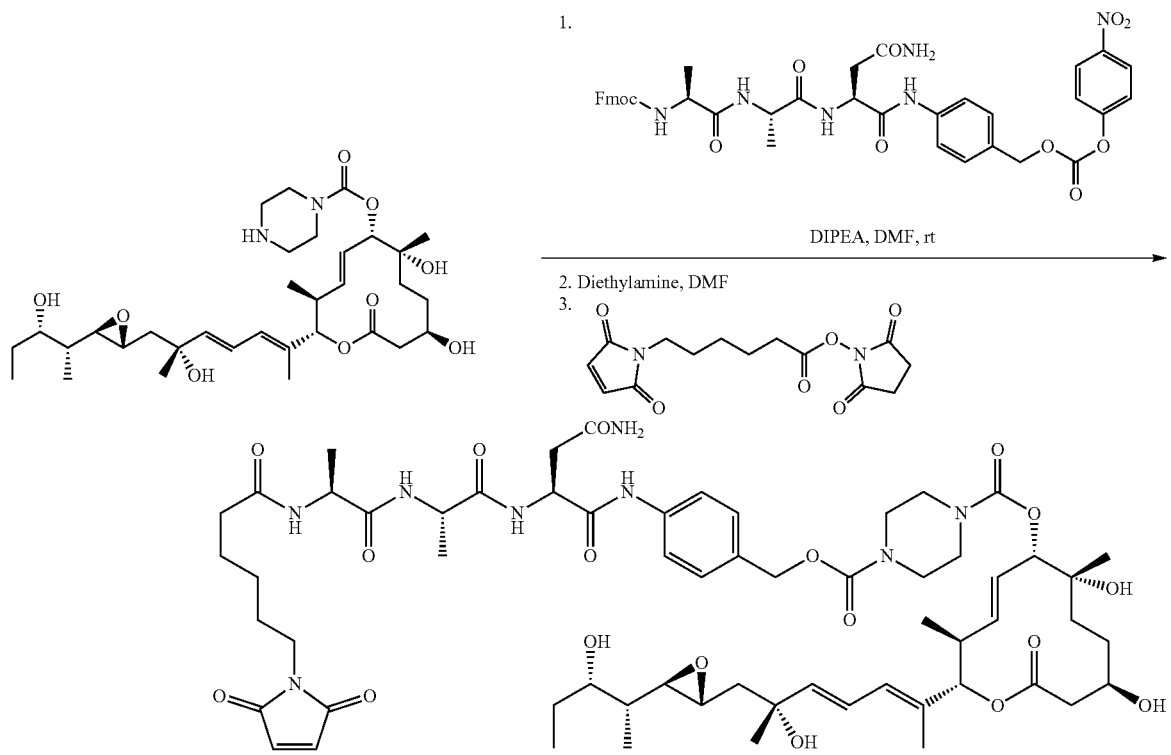

ADL21-D1. To a stirred solution of (2S,3S,6S,7R,10R,E)-7,10-dihydroxy-2-((R,2E,4E)-6-hydroxy-7-((2R,3R)-3-((2R,3S)-3-hydroxypentan-2-yl)oxiran-2-yl)-6-methyl-hepta-2,4-dien-2-yl)-3,7-dimethyl-12-oxooxacyclododec-4-en-6-yl piperazine-1-carboxylate (50 mg, 0.08 mmol) in DMF (1 mL) was added (9H-fluoren-9-yl)methyl ((S)-1-(((S)-1-(((S)-4-amino-1-((4-((((4-nitrophenoxy)carbonyl)oxy)methyl)phenyl)amino)-1,4-dioxobutan-2-yl)amino)-1-oxopropan-2-yl)amino)-1-oxopropan-2-yl)carbamate (73.9 mg, 0.096 mmol) followed by DIPEA (140 μL, 0.803 mmol). The reaction mixture was stirred for 1 hour. The reaction mixture was then concentrated to dryness and purified by silica gel column chromatography (eluting with 0-15% MeOH in DCM). The fractions containing the desired compound were concentrated to provide a clear oil that was carried directly to the following step. The oil obtained was dissolved in DMF (2 mL) and diethylamine (83 μL, 0.80 mmol) was added to the reaction mixture. The resulting mixture was stirred 1 hour at RT, after which the reaction mixture was concentrated in vacuo. The residue was re-dissolved in DMF (1 mL) and 2,5-dioxopyrrolidin-1-yl 6-(2,5-dioxo-2,5-dihydro-1H-pyrrol-1-yl)hexanoate (32.2 mg, 0.104 mmol) and DIPEA (130 μL, 0.803 mmol) was added. The resulting mixture was stirred for 1 hour. The resulting mixture was concentrated to dryness and purified under reverse-phase HPLC to furnish the titled compound. $^1$H NMR (400 MHz, DMSO-$d_6$) δ ppm 0.74-0.87 (m, 9H), 1.06 (s, 3H), 1.12-1.26 (m, 13H) 1.29-1.41 (m, 4H), 1.42-1.52 (m, 7H), 1.66-1.72 (m, 3H), 1.73-1.83 (m, 1H), 2.05-2.12 (m, 2H), 2.31-2.39 (m, 3H), 2.54-2.58 (m, 2H), 3.28-3.30 (m, 3H), 3.33-3.45 (m, 9H), 3.56-3.71 (m, 2H), 4.16-4.21 (m, 1H), 4.24-4.29 (m, 1H), 4.38-4.45 (m, 1H), 4.47-4.51 (m, 1H), 4.51-4.55 (m, 1H), 4.56-4.64 (m, 1H), 4.75-4.93 (m, 3H), 5.02 (s, 2H), 5.34-5.48 (m, 1H), 5.61-5.72 (m, 1H), 5.79-5.92 (m, 1H), 6.00-6.11 (m, 1H), 6.33-6.46 (m, 1H), 6.99 (s, 2H), 7.30 (m, 2H), 7.63 (m, 2H), 7.97-8.04 (m, 1H), 8.05-8.11 (m, 1H), 8.12-8.20 (m, 1H), 9.56-9.73 (m, 1H). LC/MS (ESI, m/z), 1222.28 [M+H]$^+$.

1.10 ADL23-D2

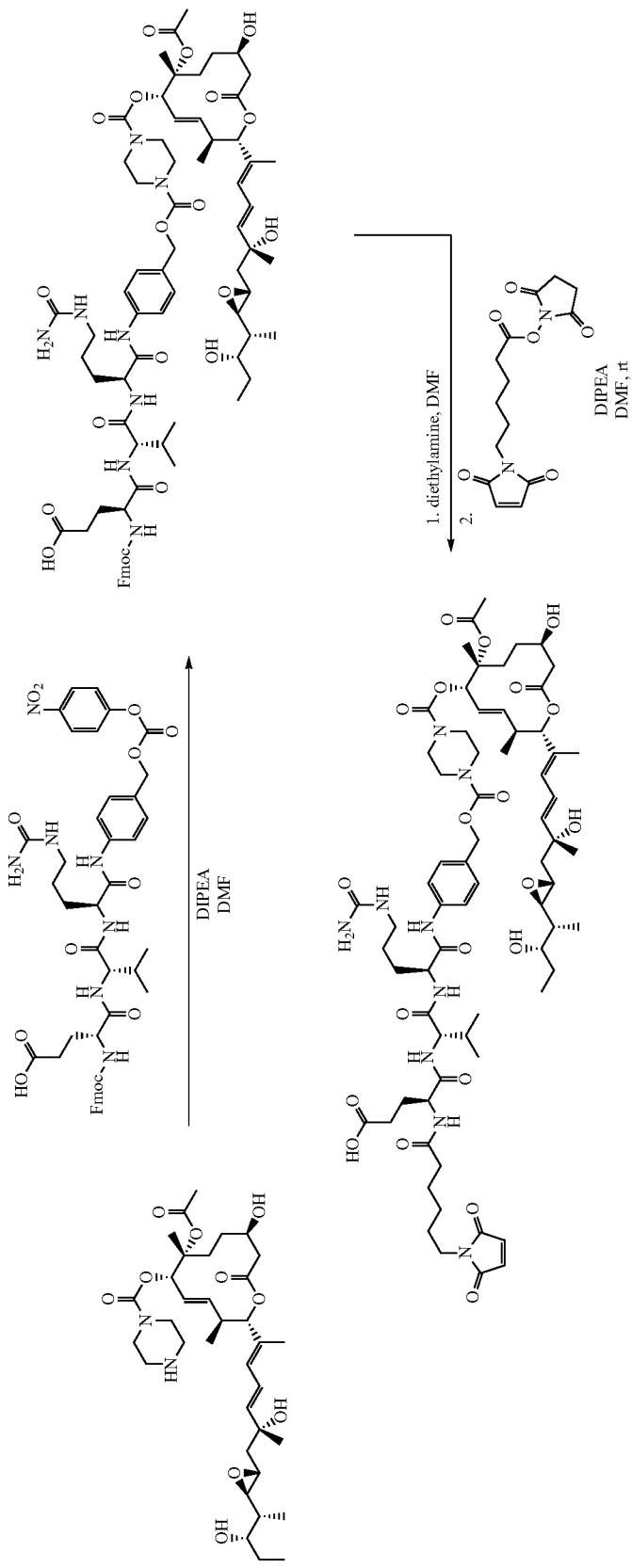

(S)-5-(((S)-1-(((S)-1-((4-(((4-(((((2S,3S,6S,7R,10R, E)-7-acetoxy-10-hydroxy-2-((R,2E,4E)-6-hydroxy-7-((2R,3R)-3-((2R,3S)-3-hydroxypentan-2-yl)oxiran-2-yl)-6-methyl hepta-2,4-dien-2-yl)-3,7-dimethyl-12-oxooxacyclododec-4-en-6-yl)oxy)carbonyl)piperazine-1-carbonyl)oxy)methyl) phenyl)amino)-1-oxo-5-ureidopentan-2-yl)amino)-3-methyl-1-oxobutan-2-yl)amino)-4-(6-(2,5-dioxo-2,5-dihydro-1H-pyrrol-1-yl)hexanamido)-5-oxopentanoic acid (ADL23-D2). To a stirred solution of (2S,3S,6S,7R,10R,E)-7-acetoxy-10-hydroxy-2-((R,2E,4E)-6-hydroxy-7-((2R, 3R)-3-((2R,3S)-3-hydroxypentan-2-yl)oxiran-2-yl)-6-methylhepta-2,4-dien-2-yl)-3,7-dimethyl-12-oxooxacyclododec-4-en-6-ylpiperazine-1-carboxylate (20 mg, 0.03 mmol) in DMF (1 mL) was added (S)-4-(((((9H-fluoren-9-yl)methoxy) carbonyl)amino)-5-(((S)-3-methyl-1-(((S)-1-((4-(((((4-nitro-phenoxy)carbonyl)oxy)methyl)phenyl)amino)-1-oxo-5-ureidopentan-2-yl)amino)-1-oxobutan-2-yl)amino)-5-oxopentanoic acid (32.3 mg, 0.036 mmol) and DIPEA (16 µL, 0.09 mmol). The reaction mixture was stirred for 1 hour at RT, after which diethylamine (155 µL, 1.504 mmol) was added. The resulting mixture was stirred for an additional 30 min at 20° C. The reaction mixture was diluted with ethyl acetate and concentrated in vacuo. The resulting residue was dissolved in DMF (1 mL) and 2,5-dioxopyrrolidin-1-yl-6-(2,5-dioxo-2,5-dihydro-1H-pyrrol-1-yl)hexanoate (14 mg, 0.045 mmol) and DIPEA (16 µL, 0.09 mmol) were added. The reaction mixture was stirred for 50 min and then diluted with ethyl acetate (to aid in the azeotropic removal of DMF). The mixture was concentrated to dryness and purified using preparative HPLC to furnish (S)-5-(((S)-1-(((S)-1-((4-(((4-(((((2S,3S,6S,7R,10R,E)-7-acetoxy-10-hydroxy-2-((R,2E, 4E)-6-hydroxy-7-((2R,3R)-3-((2R,3S)-3-hydroxypentan-2-yl)oxiran-2-yl)-6-methylhepta-2,4-dien-2-yl)-3,7-dimethyl-12-oxooxacyclododec-4-en-6-yl)oxy)carbonyl)piperazine-1-carbonyl)oxy)methyl)phenyl)amino)-1-oxo-5-ureidopentan-2-yl)amino)-3-methyl-1-oxobutan-2-yl) amino)-4-(6-(2,5-dioxo-2,5-dihydro-1H-pyrrol-1-yl) hexanamido)-5-oxopentanoic acid. $^1$H NMR (400 MHz, DMSO-$d_6$) δ ppm 0.74-0.89 (m, 16H), 1.03-1.66 (m, 25H), 1.69 (s, 4H), 1.74-1.94 (m, 2H), 2.00 (s, 4H), 2.09 (br d, 2H), 2.21 (br d, 3H), 2.31-2.42 (m, 2H), 2.53-2.84 (m, 3H), 2.89-3.09 (m, 2H), 3.34-3.48 (m, 10H), 3.65-3.74 (m, 1H), 4.19, (dd, 1H), 4.26-4.45 (m, 3H), 4.57-4.64 (m, 1H), 4.79-4.85 (m, 1H), 4.90 (br d, 2H), 5.01 (s, 2H), 5.43 (br s, 2H), 5.47-5.59 (m, 1H), 5.67-5.80 (m, 1H), 5.81-5.93 (m, 1H), 5.94-6.14 (m, 2H), 6.35-6.47 (m, 1H), 6.99 (s, 2H), 7.30 (d, 2H), 7.58, (d, 2H), 7.63-7.71 (m, 1H), 7.98-8.06 (m, 1H), 8.15-8.27 (m, 1H), 9.99-10.09 (m, 1H). LC/MS (ESI, m/z), 1393.4 [M+H]$^+$.

Example 2

Exemplary splicing modulator payloads used in the preparation of ADCs were evaluated as described below.

2.1 SF3B1 Binding/Scintillation Proximity Assay (SPA)

A scintillation proximity assay was performed to measure the binding affinity of compounds ("payloads") to the SF3b complex. Batch immobilization of anti-SF3B1 antibody (MBL) to anti-mouse PVT SPA scintillation beads (PerkinElmer) was prepared. For every 2.5 mg of nuclear extracts, 5 µg of anti-SF3B1 antibody and 1.5 mg of beads were mixed in 150 µL PBS. The antibody-bead mixture was incubated for 30 min at room temperature (RT) and centrifuged at 18,000 g for 5 min. 150 µL PBS was used to resuspend every 1.5 mg antibody-bead mixture. The beads were suspended and added to the prepared nuclear extracts. The slurry was incubated for 2 hours at 4° C. with gentle mixing. The beads were then collected by centrifuging at 18,000 g for 5 min, and washed twice with PBS+0.1% Triton X-100. After a final centrifugation step, every 1.5 mg of beads was suspended with 150 µL of PBS. SF3b complexes were tested for [$^3$H]-labeled pladienolide B probe binding ([$^3$H]-PB), synthesized as previously described (Kotake et al. (2007) Nat Chem Biol. 3(9):570-5). 100 µL binding reactions were prepared with 50 µL bead slurry and by adding varying concentrations of PB or PB-OH, and after 30 min pre-incubation, 2.5 nM of [$^3$H]-PB was added. The mixture was incubated for 30 min, and luminescence signals were read using a MicroBeta2 Plate Counter (PerkinElmer). Prism 7 (GraphPad) was used for non-linear regression curve fitting of the data.

Similar binding profiles were observed for the tested payloads, D1 and D2 (Table 15). In general, specific binding was in the low nanomolar range, suggesting that the tested payloads are both potent SF3b complex binders and candidate compounds for use in ADCs.

2.2 In Vitro Splicing (IVS)

To evaluate payload activity in a cell-free system, an in vitro splicing assay was performed. The payloads were incubated with nuclear extracts and pre-mRNA substrate minigenes.

HeLa nuclear extract preparation: HeLa S3 cell pellets were resuspended in hypotonic buffer (10 mM HEPES pH 7.9, 1.5 mM MgCl$_2$, 10 mM KCl, 0.2 mM PMSF, 0.5 mM DTT) and the suspension was brought up to a total of 5 packed cell volume (PCV). After centrifugation, the supernatant was discarded, and the cells were brought up to 3 PCV with hypotonic buffer and incubated on ice for 10 min. Cells were lysed using a dounce homogenizer and then centrifuged. The supernatant was discarded, and the pellet was resuspended with ½ packed nuclear volume (PNV) of low salt buffer (20 mM HEPES pH 7.9, 1.5 mM MgCl$_2$, 20 mM KCl, 0.2 mM EDTA, 25% glycerol, 0.2 mM PMSF, 0.5 mM DTT), followed by ½ PNV of high salt buffer (same as low salt buffer except 1.4 M KCl). The nuclei were gently mixed for 30 min before centrifuging. The supernatant (nuclear extract) was then dialyzed into storage buffer (20 mM HEPES pH 7.9, 100 mM KCl, 0.2 mM EDTA, 20% glycerol, 0.2 mM PMSF, 0.5 mM DTT). Protein concentration was determined using NanoDrop 8000 UV-Vis spectrophotometer (ThermoFisher Scientific).

IVS: Ad2.1 and Ad2.2, which are engineered splicing substrates with stronger affinity (Ad2.1) and weaker affinity (Ad2.2) for the U2 snRNP, were used in the IVS assay (Finci et al. (2018) Genes Dev. 32(3-4):309-320). All Ad2-derived sequences (Pellizzoni et al. (1998) Cell 95(5):615-24) were cloned into pcDNA3.1(+) vector (Promega) using 5' EcoRI and 3' XbaI restriction sites. The plasmids were linearized using XbaI and used as DNA templates in in vitro transcription reactions. The FtzΔi intron-less plasmid (Luo and Reed (1999) 96(26):14937-42) was linearized using EcoRI. All RNAs were in vitro transcribed and then purified using MEGAScript T7 (Invitrogen) and MegaClear (Invitrogen) kits, respectively. For splicing reactions using Ad2 variant pre-mRNAs, 1 µL reactions were prepared using 8 µg nuclear extracts prepared from HeLa S3, 2 ng pre-mRNA, 0.2 ng FTZΔi, and varying concentrations of compounds or DMSO. After a 15 min pre-incubation at 30° C., 1 µL splicing activation buffer (0.5 mM ATP, 20 mM creatine phosphate, 1.6 mM MgCl$_2$) was added, and the reactions were incubated for 90 min at 30° C. The reactions were then quenched with 13 µL DMSO, and 25 nL was used for RT-qPCR. RT-qPCR reactions were prepared using TaqMan RNA-to-C$_T$ 1-step kit (Life Technologies), RNA from splicing reactions, Ad2 (forward: ACTCTCTTCCG-CATCGCTGT (SEQ ID NO: 128); reverse: CCGACGGGTTTCCGATCCAA (SEQ ID NO: 129); probe: CTGTTGGGCTCGCGGTTG (SEQ ID NO: 130)) and Ftz (forward: TGGCATCAGATTGCAAAGAC (SEQ ID NO: 131); reverse: ACGCCGGGTGATGTATCTAT (SEQ ID NO: 132); probe: CGAAACGCACCCGTCA-GACG (SEQ ID NO: 133)) mRNA primer-probe sets. Prism 7 (GraphPad) was used for non-linear regression curve fitting of the formed spliced product and normalized to the control (DMSO) sample.

The tested payloads, D1 and D2, both modulated splicing of Ad2.2 pre-mRNA (Table 15). In general, in the presence of payload, a decrease in the amount of spliced product was observed.

2.3 Cell Viability

NCI-H929 (American Type Culture Collection (ATCC)) multiple myeloma cells were plated at 2000 cells/well in flat bottom 96-well tissue culture plates (Corning) in a total volume of 90 µL tissue culture medium supplemented with 10% fetal bovine serum (ThermoFisher Scientific). Cells were treated with a 3-fold serial dilution of compound from 200 nM to 0.03 nM. Each concentration was tested in triplicate. At the time of treatment, a plate of untreated cells was evaluated using a CellTiter-Glo® 2.0 Luminescent Cell Viability Assay according to the manufacturer's recommendations (Promega; #G9241). CellTiter-Glo® 2.0 reagent was added to the medium, incubated, and assayed on an EnVision Multilabel Reader (PerkinElmer). Values represent time zero (T0). The number of viable cells following 144 hours (T144) of compound treatment was also determined using the CellTiter-Glo® 2.0 Luminescent Cell Viability Assay. Using the luminescence value at time zero (T0), DMSO control growth (C), and test growth in the presence of compound (T144), the percentage growth was calculated at each of the compound concentrations levels. Percentage growth inhibition was calculated as: [(T144−T0)/(C−T0)]×100 for concentrations for which T144≥T0 or [(T144−T0)/T0]×100 for concentrations for which T144<T0. The dose response curve plots were generated using Prism 7 (GraphPad) and fit using nonlinear regression analysis and the log(inhibitor) versus response-variable slope (four parameters).

Cell viability dose response was determined for the tested payloads in BCMA-expressing cell lines, including in NCI-H929, MM1.S, MM1.R, and OPM2 multiple myeloma cells. D1 and D2 both exhibited $GI_{50}$ values (i.e., concentration of compound to cause 50% reduction in cell proliferation) in the double digit nanomolar range (Table 15), which is generally consistent with the permeability data. Exemplary permeability data is described below and shown in Table 15.

2.4 Caco-2 Permeability

Caco-2 cells were cultured for 21 days in transwell 24-well plates at 37° C., 95% humidity, 5% $CO_2$. Integrity of cell monolayer was confirmed by TEER (transepithelial electrical resistance) and Lucifer yellow. Payloads were spiked in duplicate at 10 µM, separately, on both sides of the cell monolayer. Permeability rates from the apical to basolateral (A-B) direction and the basolateral to apical (B-A) direction were determined by sampling aliquots from both chambers immediately after treatment (t=0) and following incubation for 2 hours. Samples were protein precipitated with organic solvent containing internal standard and analyzed by LC-MS/MS (SCIEX; API 5500). The area ratio responses of payload/internal standard over time in both directions were used to generate permeability (cm/sec) values. Efflux ratio was calculated by dividing B-A/A-B. Control compounds for low and high permeability and efflux behaved as expected. Permeability values for D1 and D2 are shown in Table 15.

2.5 Chemical Stability

Payloads were incubated in Mcilvane (Citrate-Phosphate) buffer, pH 5.5 (Boston Bioproducts; #BB-2466) at a final concentration of 20 µM (less than 0.5% DMSO from stock solution). The payload solution and the internal standard were pipetted into 96-well plates, run on UPLC (Waters Aquity H class), and analyzed for initial chromatographic signal (t=0). The column was a Waters UPLC HSS T3 1.8 µm 2.1×50 mm column (#186003538). A gradient of mobile phase A from 95% to 10% was employed over 1 min, where A was 0.1% formic acid in water and mobile phase B was 0.1% formic acid in acetonitrile (flow rate 0.9 mL/min). The remainder of the payload solution was kept in a plate shaker at 37° C. (Eppendorf ThermoMixer). Sample analyses by UPLC were repeated at 24, 72, and 96 hours post-incubation at 37° C. The area ratio response of the payload and internal standard was determined for three time points: time 0, day 1, and either day 3 or day 4. Time 0 was set to 100. The area ratio responses of the later time points were compared to time 0. Percent remaining was calculated as follows: (Area Ratio day X/Area Ratio time 0)*100=% remaining. The slope of the line was calculated in Excel comparing the log of % remaining and time point. Half-lives were calculated in Excel by ln(2)/slope and are shown in Table 15.

TABLE 15

Biochemical/physicochemical characterization of exemplary ADC payloads

| Assay | Payload D1 | Payload D2 |
|---|---|---|
| SPA $IC_{50}$ (nM) | 21.3 | 12.6 |
| qPCR-IVS HELA Ad2.1 IC50 (nM) | 16.5 | 27.3 |
| qPCR-IVS HELA Ad2.2 IC50 (nM) | 25 | 118.9 |
| CTGlo Mean $GI_{50}$ MM1.S 96 h (nM) | 37.08 | 1.69 |
| CTGlo Mean $LD_{50}$ MM1.S 96 h (nM) | 98.2 | 7.74 |
| CTGlo Mean $GI_{50}$ MM1.R 96 h (nM) | 146.9 | 7.59 |
| CTGlo Mean $LD_{50}$ MM1.R 96 h (nM) | 510.8 | 21.4 |
| CTGlo Mean $GI_{50}$ OPM2 96 h (nM) | 287.4 | 1.69 |
| CTGlo Mean $LD_{50}$ OPM2 96 h (nM) | 67.1 | 7.74 |
| CTGlo Mean $GI_{50}$ H929 96 h (nM) | 75.5 | ND |
| CTGlo Mean $LD_{50}$ H929 96 h (nM) | 201 | ND |
| CTGlo Mean $GI_{50}$ MOLP8 96 h (nM) | ND | 1.15 |
| CTGlo Mean $LD_{50}$ MOLP8 96 h (nM) | ND | 12.99 |
| Permeability; Mean; Caco-2 A-B Perm (10e−6 cm/s) | 0.2 | 0.94 |
| Permeability; Mean; Caco-2 B-A Perm (10e−6 cm/s) | 0.3 | 0.1 |
| Permeability; Mean; Caco-2 Efflux ratio | 1.5 | 9.4 |
| Stability; Mean; Perm PAMPA (10e−6 cm/s) | <0.1 | <0.1 |
| Stability %; Mean; $t_{1/2}$ pH 5.5 | 1 | 4 |

ND = no data; SPA = scintillation proximity assay; qPCR-IVS = in vitro splicing assay, qPCR readout; CTGlo = CellTiter-Glo ® cell viability assay.

Example 3

A mutagenesis screen to identify humanized anti-BCMA antibodies was performed as described below.

3.1 Screen Overview

Using an iterative process that combined machine learning and design of experiment (DOE) techniques, a variety of heavy chain and light chain variants of the AB200 antibody clone were generated. AB200 is described in, e.g., U.S. Pat. No. 9,273,141, which is incorporated herein by reference. Exemplary AB200 sequences are also provided in Table 9. The screen used Fab fragments rather than full-length IgG1 antibodies, and was performed in three rounds (rounds 0, 1, and 2).

3.1.1 Round 0

In the initial screening round (round 0), amino acids were screened to replace an aspartic acid (D) in the AB200 heavy chain at Kabat position 99 (absolute position 103). Six individual mutations of the aspartic acid at Kabat position 99 were made and paired with the non-mutated light chain Fab fragment of AB200.

The binding affinity of each mutated clone for the extracellular domain of human and monkey BCMA was determined by Octet assay (ForteBio). Amine Reactive $2^{nd}$ Generation (AR2G) tips loaded with the extracellular domain of human or rhesus monkey BCMA (amino linked) were generated and incubated in a 200 nM solution of each antibody clone (all clones in Fab format). Ligand association and dissociation were determined over 600 seconds (300 seconds for each stage). BCMA binding affinity was assessed using the same Octet assay conditions for all subsequent clones identified in screening rounds 1 and 2.

Results from round 0 are summarized in Tables 16 and 17. The AB200_Fab (D99D) clone was analyzed to provide a benchmark for assessing the impact of each substitution on BCMA binding affinity.

The D99N variant (harboring an asparagine (N) at Kabat position 99/absolute position 103) showed the strongest binding to both human and monkey BCMA. Without wishing to be bound by theory, some asparagines can become deamidated, which can result in chemistry, manufacturing, and control (CMC) challenges and/or increased heterogeneity in a drug product. Furthermore, it has been demonstrated that deamidation of asparagines located within CDRs can negatively impact, e.g., reduce, antigen binding. Further variants were therefore evaluated.

The D99H variant (harboring a histidine (H) at Kabat position 99/absolute position 103) showed improved binding affinity over the D99D reference clone, as well as high binding affinity for both human and monkey BCMA. This variant was selected for further rounds of mutagenesis.

3.1.2 Round 1

In the next screening round (round 1), the AB200_Fab (D99H) heavy chain fragment was paired with 39 unique kappa light chains containing CDR mutations. For all pairs, binding affinity for the extracellular domain of human and monkey BCMA was determined by Octet assay (ForteBio), and thermostability ($T_m$) was assessed using a ThermoFluor assay (Table 38). Of the clones tested, the AB200 kappa variant 6 (AB200-R1a-Fab_Vk6) bound to human and monkey BCMA with the highest affinity (1.11 and 4.261 nM, respectively), and bound with higher affinity than the AB200_Fab (D99H) parental clone (2.08 and 5.7 nM for human and monkey, respectively).

Next, 60 unique heavy chain variants of AB200_D99H_Fab harboring mutations in the CDRs were designed, expressed, paired with the AB200_Vk6_Fab, and screened for BCMA binding and thermostability (Table 39). AB200-R1a-Fab-VH26 and AB200-R1a-Fab_VH32 both bound to human and monkey BCMA with high affinity: AB200-R1a-Fab_VH26 (0.926 and 2.311 nM) and AB200-R1a-Fab_VH32 (1.088 and 4.169 nM) for human and monkey, respectively.

3.1.3 Round 2

In the final screening round (round 2), 48 light chain variants ($R^2Vk1$-$R^2Vk48$) were paired with round 1 heavy chain AB200-R1a-Fab_VH26, and all but one of those light chain variants ($R^2Vk1$-$R^2Vk47$) were paired with round 1 heavy chain AB200-R1a-Fab_VH32. Thermostability and binding affinity to human and monkey BCMA were assessed (Tables 40 and 41).

A library of 88 heavy chain variants was also created, and subsets of this library were paired with five light chains from the round 2 screening (Tables 42-46), as summarized here:
AB200-(2Vk30)+19 round 2 heavy chain variants
AB200-(2Vk31)+25 round 2 heavy chain variants
AB200-(2Vk8)+8 round 2 heavy chain variants
AB200-(2Vk35)+19 round 2 heavy chain variants
AB200-(2Vk44)+19 round 2 heavy chain variants

TABLE 16

Binding kinetics for BCMA (human)

| Clone ID | $K_{on}$ (nM$^{-1}$ s$^{-1}$) | +/−SEM | $K_{off}$ (s$^{-1}$) | +/−SEM | $K_d$ (nM) | +/−SEM |
|---|---|---|---|---|---|---|
| AB200_Fab (D99D) | 0.00017 | 1.97E−06 | 0.00058 | 2.32E−06 | 3.45 | 0.05 |
| AB200_Fab + D99N | 0.00019 | 2.06E−06 | 0.00023 | 3.33E−06 | 1.23 | 0.00 |
| AB200_Fab + D99S | 0.00011 | 1.44E−06 | 0.00044 | 8.08E−06 | 3.86 | 0.02 |
| AB200_Fab + D99T | 0.00008 | 6.43E−07 | 0.00030 | 9.46E−06 | 3.72 | 0.09 |
| AB200_Fab + D99E | 0.00015 | 2.17E−06 | 0.00091 | 4.34E−06 | 5.92 | 0.06 |
| AB200_Fab + D99H | 0.00018 | 2.49E−06 | 0.00037 | 1.30E−05 | 2.08 | 0.10 |
| AB200_Fab + D99Q | 0.00017 | 1.02E−05 | 0.00053 | 8.52E−06 | 3.06 | 0.13 |

TABLE 17

Binding kinetics for BCMA (rhesus monkey)

| Clone ID | Kon (nM$^{-1}$ s$^{-1}$) | +/−SEM | $K_{off}$ (s$^{-1}$) | +/−SEM | $K_d$ (nM) | +/−SEM |
|---|---|---|---|---|---|---|
| AB200_Fab (D99D) | 0.0002 | 3.33E−06 | 0.00118 | 1.75E−06 | 5.89 | 0.11 |
| AB200_Fab + D99N | 0.0002 | 1.85E−06 | 0.00066 | 9.77E−06 | 3.32 | 0.02 |
| AB200_Fab + D99S | 0.00012 | 8.83E−07 | 0.00114 | 1.73E−05 | 9.75 | 0.07 |
| AB200_Fab + D99T | 0.00009 | 1.65E−06 | 0.00099 | 3.59E−06 | 11.5 | 0.18 |
| AB200_Fab + D99E | 0.00016 | 2.96E−06 | 0.00219 | 1.83E−05 | 13.61 | 0.14 |
| AB200_Fab + D99H | 0.00018 | 3.64E−06 | 0.00105 | 1.16E−05 | 5.7 | 0.05 |
| AB200_Fab + D99Q | 0.00018 | 2.12E−06 | 0.0014 | 1.65E−05 | 7.63 | 0 |

Based on several parameters, such as improved properties relative to the AB200 reference antibody clone (e.g., improved binding affinity for human BCMA, similarity in binding affinity for human vs. monkey BCMA, and/or improved thermostability), six combinations of heavy and light chain variants were selected for conversion to full-length IgG1 antibodies and expression scale-up (AB212, AB213, AB214, AB216, AB217, and AB218). A seventh combination (AB215) was also selected based on extrapolation of data from the individual heavy and light chains. Data for selected clones is shown in Table 18.

TABLE 18

Selected Clones

| Clone ID-1 | Clone ID-2 | $K_d$ hsBCMA (nM) | $K_d$ RhBCMA (nM) | $T_m$ (° C.) |
|---|---|---|---|---|
| AB212 | AB200_VH2-20_VK2-31 | 38.64 | 79.29 | 81.2 |
| AB213 | AB200_VH2-03_VK2-31 | 2.70 | 5.03 | 85.9 |
| AB214 | AB200_VH2-37_VK2-30 | 1.14 | 6.33 | 81.9 |
| AB215 | AB200_VH2-03_VK2-30 | ND | ND | ND |
| AB216 | AB200_VH2-75_VK2-44 | 1.07 | 5.53 | 78.4 |
| AB217 | AB200_VH2-06_VK2-35 | 1.66 | 9.60 | 78.0 |
| AB218 | AB200_VH2-27_VK2-31 | 6.43 | 13.95 | 86.0 |

ND = no data;
hsBCMA = human BCMA;
RhBCMA = Rhesus monkey BCMA

Example 4

Payloads described in Examples 1 and 2 were conjugated to exemplary anti-BCMA antibodies via cysteine residues on the antibody (see section 4.2 below). The preparation and evaluation of exemplary anti-BCMA ADCs is described below.

4.1 Antibodies

Anti-BCMA antibodies AB212, AB213, AB214, AB215, AB216, AB217, and AB218 were used for the preparation of anti-BCMA ADCs. ADCs may also be referred to herein as splicing modulator-loaded antibodies (SMLAs).

4.2 Bioconjugation 10 mg/mL of each antibody in PBS buffer (pH 7.0) was mixed with 5 mM TCEP (2-4 molar equivalents) (ThermoFisher Scientific; #77720) to break interchain disulfide bonds. The reaction was gently mixed at 22° C. for 3 hours. 8-12 molar equivalents of linker-payload (6 mM stock in DMSO) was then added, and the solution was mixed thoroughly. The reaction was placed onto a rotary plate in an incubator at 22° C. After a 2-hour conjugation, the reaction mixture was purified to remove unconjugated payload by AKTA GE M150 (HiTrap™ 26/10 desalting column; 40 kDa, 10 mL) (GE Healthcare Bio-Sciences) into 20 mM histidine/acetic acid buffer (pH 6.0). The resulting conjugate was concentrated via Amicon ultrafiltration (30 kDa, Ultra-4) (EMD Millipore) and submitted to sterile filtration through a 0.22 μm PVDF disposable filter (EMD Millipore). The final clear solution was measured by UV-VIS to determine antibody concentration ([mAb]; mol/L) and conjugated payload concentration ([LD]; mol/L) according to the Beer-Lambert law (A=E*c*l) and the following equations:

$$A_{280nm} = E^{mAb}_{280nm} * [mAb] * l + E^{LD}_{280nm} * [LD] * l$$

$$A_{252nm} = E^{mAb}_{252nm} * [mAb] * l + E^{LD}_{252nm} * [LD] * l$$

TABLE 19

$E^{mAb}_{280\,nm}$ Values

| mAb | $E^{mAb}280$ nm (cm$^{-1}$M$^{-1}$) |
|---|---|
| AB212 | 220420 |
| AB213 | 223400 |
| AB214 | 229360 |
| AB215 | 226380 |
| AB216 | 229360 |
| AB217 | 229360 |
| AB218 | 223400 |

$E^{LD}_{280nm} = 800$ cm$^{-1}$M$^{-1}$
$E^{LD}_{252nm} = 800$ cm$^{-1}$M$^{-1}$

Abbreviations: c—molar concentration; l—light path length (Nanodrop: 0.1 cm); E—molar extinction coefficient; A—absorbance.

4.3 Biophysical Characterization

The drug-to-antibody ratio (DAR), percent aggregation, and percent unconjugated payload were analyzed for exemplary anti-BCMA ADCs by liquid chromatography-mass spectrometry (LC/MS), size exclusion chromatography (SEC), and reverse-phase high-performance liquid chromatography (HPLC), respectively. In general, the tested ADCs contained less than 2% free drug and contained less than 10% aggregate.

4.3.1 LC/MS Analysis—DAR

LC/MS analysis was performed using an Agilent 1290 UPLC system interfaced to an Agilent G6224A Accurate Mass TOF mass spectrometer. Each conjugate was deglycosylated with PNGase F (New England Biolabs; #P0705L) for 4 hours at 37° C., denatured with 8 M Gdn-HCl (Sigma; #G9284), and separated into light and heavy chain domains using DTT (5 mM final concentration) (Promega; #V3151). The prepared sample was injected onto an Agilent PLRP-S column (2.1×150 mm, 8 μm) and eluted with a gradient of 25% B to 50% B over 28 min at room temperature (RT). Mobile phase A was water with 0.05% TFA, mobile phase B was acetonitrile with 0.04% TFA, and the flow rate was 1 mL/min. DAR was calculated from the deconvoluted mass spectrum by weighted averaging the intensities of the unconjugated and drug conjugated peaks for the light chain (L0 or L1) and heavy chain (H0, H1, H2, and H3). The total DAR of the intact conjugate was calculated using the equation: $(DAR_{LC}*2)+(DAR_{HC}*2)$=total DAR. DAR values for exemplary anti-BCMA ADCs are shown in Table 20.

4.3.2 SEC Analysis—Aggregation

Size exclusion chromatography was performed using a TOSON-G3000SWXL (#008541) column in 0.2 M potassium phosphate (pH 7) with 0.25 mM potassium chloride and 15% (v/v) IPA at a flow rate of 0.75 mL/min. The peak area absorbance at 280 nm was determined for the high molecular weight and monomeric conjugate components by area under the curve integration. Percent monomer for exemplary anti-BCMA ADCs is shown in Table 20.

4.3.3 HPLC Analysis—Free Drug

Conjugate was precipitated with 10 volumes of acetonitrile on ice for 2 hours and spun down. Supernatants containing residual unconjugated payload were then injected onto an Agilent Poroshell 120 SB-C$_{18120}$A column (4.6×100 mm, 2.7 μm) and eluted with a gradient of 45% B to 70% B over 10 min at RT. Mobile phase A was 100% water, mobile phase B was 100% acetonitrile, and the flow rate was 0.6 mL/min with detection at 252 nm. The amount of residual free drug was quantified via UV detection with comparison to the external standard curve of unconjugated linker-payload. Percent free drug for exemplary anti-BCMA ADCs is shown in Table 20.

TABLE 20

Biophysical characterization of exemplary anti-BCMA ADCs

| SMLA Batch ID | Antibody | Sample | Linker | DAR | Concentration (mg/mL) | Endotoxin | Free Drug (%) | Percent Monomer |
|---|---|---|---|---|---|---|---|---|
| AB200ADL1-D2-04 | AB200 | D2-01 | ADL1-01 | 4.25 | 3.04 | | | |
| AB200-ADL1-D1-03 | AB200 | D1-01 | ADL1-01 | 3.98 | 4.73 | <0.106 | <0.20 | 98.58 |
| AB216-ADL1-D1-02 | AB216-01 | D1-01 | ADL1-01 | 7.69 | 5.65 | <0.088 | 0.13 | 99 |
| AB216-ADL1-D1-01 | AB216-01 | D1-01 | ADL1-01 | 4.87 | 4.67 | <0.16 | <0.25 | 99.20 |
| AB216-ADL1-D1-04 | AB216-02 | D1-01 | ADL1-01 | 4.01 | 5.22 | 0.11 | 0.18 | 97.06 |
| AB215-ADL1-D2-03 | AB215-01 | D2-02 | ADL1-01 | 7.91 | 4.05 | <0.12 | 0.95 | 99.07 |
| AB216-ADL1-D2-02 | AB216-01 | D2-02 | ADL1-01 | 3.8 | 4.91 | 0.102 | 1.63 | 99.11 |
| AB214-ADL21-D2-01 | AB214-01 | D2-02 | ADL21-01 | 4.0 | 0.76 | ND | ND | 99 |
| AB217-ADL1-D2-02 | AB217-01 | D2-02 | ADL1-01 | 3.7 | 4.25 | 0.12 | 0.5 | 97.88 |
| AB218-ADL1-D2-02 | AB218-01 | D2-02 | ADL1-01 | 3.77 | 4.68 | 0.13 | 0.26 | 99.9 |
| AB214-ADL1-D2-02 | AB214-01 | D2-02 | ADL1-01 | 4.12 | 3.94 | 0.127 | 0.5 | 100 |
| AB212-ADL1-D1-02 | AB212-02 | D1-01 | ADL1-01 | 3.92 | 4.8 | <0.28 | 0.51 | 99.16 |
| AB215-ADL21-D2-03 | AB215-01 | D2-01 | ADL21-01 | 4.04 | 4.31 | <0.116 | 0.29 | 99.32 |
| AB216-ADL1-D2-03 | AB216-01 | D2-02 | ADL1-01 | 3.93 | 4.17 | <0.17 | 0.76 | 99.11 |
| AB213-ADL1-D2-02 | AB213-01 | D2-02 | ADL1-01 | 4.18 | 4.66 | 0.107 | 0.0 | 99 |
| AB215-ADL1-D2-02 | AB215-01 | D2-02 | ADL1-01 | 3.96 | 3.97 | 0.126 | 0.35 | 99.13 |
| AB212-ADL1-D2-02 | AB212-01 | D2-02 | ADL1-01 | 5.17 | 4.79 | 0.104 | 2.1 | 100 |
| AB212-ADL1-D1-04 | AB212-02 | D1-01 | ADL1-01 | 3.84 | 4.0 | ND | 3.87 | 100 |
| AB212-ADL1-D2-03 | AB212-01 | D2-01 | ADL1-01 | 4.08 | 4.64 | 0.003 | 0.14 | 99.58 |
| AB212-ADL1-D1-05 | AB212-04 | D1-01 | ADL1-01 | 3.99 | 4.99 | 0.13 | 0.23 | 98.24 |
| AB216-ADL21-D1-01 | AB216-01 | D1-01 | ADL21-01 | 4.38 | 5.63 | ND | ND | 97.7 |
| AB216-ADL21-D2-01 | AB216-01 | D2-01 | ADL21-01 | 4.54 | 4.62 | 0.11 | 0.19 | 99.33 |
| AB216-ADL1-D2-04 | AB216-01 | D2-02 | ADL1-01 | 7.83 | 4.66 | 0.11 | 1.40 | 98.19 |
| AB215-ADL1-D1-01 | AB215-01 | D1-01 | ADL1-01 | 2.84 | 1.55 | ND | ND | ND |
| AB214-ADL1-D1-02 | AB214-01 | D1-01 | ADL1-01 | 3.91 | 4.9 | 0.29 | 0.41 | 97.99 |
| AB214-ADL1-D1-01 | AB214-01 | D1-01 | ADL1-01 | 4 | 0.96 | ND | ND | 97.7 |
| AB212-ADL1-D1-03 | AB212-02 | D1-01 | ADL1-01 | 7.86 | 3.89 | 0.32 | 0.14 | 97.71 |

ND = no data.

4.4 Accelerated Stability Testing

Exemplary anti-BCMA ADCs (~1 mg each in Eppendorf tubes, ~4-5 mg/mL) were centrifuged and measured by UV absorption (NanoDrop) at 280 nm to determine protein concentrations. Samples were then incubated in a 37° C. water bath and sampled at four time points, 0 (freshly prepared), 1 day, 2 days, and 4 days. Samples taken at different time points were stored at −80° C. until the last sampling was completed. After thawing at 22° C., samples were analyzed with SEC and hydrophobic interaction chromatography (HIC) for quantification of antibody aggregation and DAR. Percent aggregation, concentration, and DAR values for exemplary anti-BCMA ADCs at four time points are shown in Table 21.

TABLE 21

Accelerated stability testing of exemplary anti-BCMA ADCs

| SMLA Batch ID | Storage Buffer | Days at 37° C. | Aggregation (%) | Concentration (mg/mL) | DAR (HIC) |
|---|---|---|---|---|---|
| AB214-ADL1-D2-06 | 20 mM Histidine/HOAc pH 6.0 | 0 d | 1.13% | 4.35 | 3.90 |
| | | 1 d | 1.57% | 4.45 | 3.89 |
| | | 2 d | 1.71% | 4.53 | 3.85 |
| | | 4 d | 3.39% | 4.55 | 3.87 |
| AB214-ADL1-D1-01 | 20 mM Histidine/HOAc pH 6.0 | 0 d | 1.32% | 4.87 | 3.89 |
| | | 1 d | 1.39% | 4.93 | 3.92 |
| | | 2 d | 1.41% | 4.93 | 3.92 |
| | | 4 d | 3.59% | 5.06 | 3.92 |
| AB212-ADL1-D2-03 | 20 mM Histidine/HOAc pH 6.0 | 0 d | 1.06% | 3.92 | 4.05 |
| | | 1 d | 1.42% | 3.93 | 4.04 |
| | | 2 d | 1.56% | 4.00 | 4.06 |
| | | 4 d | 4.48% | 3.68 | 4.06 |
| AB212-ADL1-D1-02 | 20 mM Histidine/HOAc pH 6.0 | 0 d | 1.10% | 4.97 | 3.90 |
| | | 1 d | 1.24% | 5.02 | 3.90 |
| | | 2 d | 1.26% | 5.02 | 3.90 |
| | | 4 d | 4.82% | 4.47 | 3.87 |
| AB216-ADL1-D2-03 | 20 mM Histidine/HOAc pH 6.0 | 0 d | 0.87% | 4.12 | 3.91 |
| | | 1 d | 0.92% | 4.15 | 3.92 |
| | | 2 d | 1.17% | 4.14 | 3.88 |
| | | 4 d | 1.92% | 4.18 | 3.92 |
| AB216-ADL1-D2-04 | 20 mM Histidine/HOAc pH 6.0 | 0 d | 1.61% | 4.65 | 7.88 |
| | | 1 d | 2.83% | 4.67 | 7.86 |
| | | 2 d | 3.81% | 4.70 | 7.86 |
| | | 4 d | 6.72% | 4.88 | 7.83 |
| AB212-ADL1-D1-03 | 20 mM Histidine/HOAc pH 6.0 | 0 d | 4.58% | 3.87 | 7.81 |
| | | 1 d | 5.02% | 3.90 | 7.87 |
| | | 2 d | 5.82% | 4.04 | 7.81 |
| | | 4 d | 10.13% | 3.77 | 7.78 |
| AB212-ADL1-D2-02 | 20 mM Histidine/HOAc pH 6.0 | 0 d | 1.10% | 4.96 | 5.19 |
| | | 1 d | 1.52% | 4.85 | 5.24 |
| | | 2 d | 1.83% | 4.95 | 5.19 |
| | | 4 d | 1.62% | 5.01 | 5.21 |
| AB213-ADL1-D2-02 | 20 mM Histidine/HOAc pH 6.0 | 0 d | 0.72% | 4.73 | 4.20 |
| | | 1 d | 2.02% | 4.56 | 4.20 |
| | | 2 d | 1.71% | 4.61 | 4.29 |
| | | 4 d | 1.98% | 4.81 | 4.40 |
| AB214-ADL1-D2-02 | 20 mM Histidine/HOAc pH 6.0 | 0 d | 0.58% | 4.58 | 4.30 |
| | | 1 d | 0.87% | 4.48 | 4.30 |
| | | 2 d | 1.18% | 4.53 | 4.26 |
| | | 4 d | 1.01% | 4.70 | 4.61 |
| AB215-ADL1-D2-02 | 20 mM Histidine/HOAc pH 6.0 | 0 d | 1.25% | 5.28 | 4.80 |
| | | 1 d | 1.72% | 4.99 | 4.74 |
| | | 2 d | 1.59% | 5.21 | 4.77 |
| | | 4 d | 2.14% | 5.69 | 5.01 |
| AB216-ADL1-D2-02 | 20 mM Histidine/HOAc pH 6.0 | 0 d | 0.65% | 4.92 | 3.81 |
| | | 1 d | 0.92% | 4.52 | 3.82 |
| | | 2 d | 1.60% | 5.56 | 3.81 |
| | | 4 d | 2.73% | 5.31 | 3.84 |

TABLE 21-continued

Accelerated stability testing of exemplary anti-BCMA ADCs

| SMLA Batch ID | Storage Buffer | Days at 37° C. | Aggregation (%) | Concentration (mg/mL) | DAR (HIC) |
|---|---|---|---|---|---|
| AB217-ADL1-D2-02 | 20 mM Histidine/ HOAc pH 6.0 | 0 d | 1.91% | 4.24 | 3.78 |
| | | 1 d | 2.20% | 4.18 | 3.77 |
| | | 2 d | 2.22% | 4.21 | 3.71 |
| | | 4 d | 2.46% | 4.47 | 3.75 |
| AB218-ADL1-D2-02 | 20 mM Histidine/ HOAc pH 6.0 | 0 d | 0.39% | 4.86 | 3.75 |
| | | 1 d | 0.60% | 5.26 | 3.71 |
| | | 2 d | 0.95% | 5.39 | 3.72 |
| | | 4 d | 1.71% | 5.09 | 3.71 |
| AB215-ADL1-D2-03 | 20 mM Histidine/ HOAc pH 6.0 | 0 d | 0.93% | 3.95 | NA |
| | | 1 d | 1.61% | 3.96 | NA |
| | | 2 d | 2.20% | 4.01 | NA |
| | | 4 d | 4.64% | 4.09 | NA |
| AB215-ADL21-D2-03 | 20 mM Histidine/ HOAc pH 6.0 | 0 d | 0.74% | 4.27 | NA |
| | | 1 d | 0.82% | 4.29 | NA |
| | | 2 d | 0.93% | 4.31 | NA |
| | | 4 d | 1.09% | 4.40 | NA |
| AB216-ADL21-D2-01 | 20 mM Histidine/ HOAc pH 6.0 | 0 d | 0.23% | 5.74 | 4.60 |
| | | 1 d | 0.72% | 5.58 | 4.62 |
| | | 2 d | 0.91% | 6.95 | 4.60 |
| | | 4 d | 0.94% | 6.01 | 4.64 |
| AB216-ADL1-D1-01 | 20 mM Histidine/ HOAc pH 6.0 | 0 d | 1.09% | 4.93 | 4.88 |
| | | 1 d | 0.67% | 4.95 | 4.91 |
| | | 2 d | 0.94% | 4.95 | 4.93 |
| | | 4 d | 1.03% | 5.06 | 4.94 |
| AB216-ADL1-D1-02 | 20 mM Histidine/ HOAc pH 6.0 | 0 d | 2.12% | 5.53 | 7.75 |
| | | 1 d | 2.59% | 5.58 | 7.72 |
| | | 2 d | 3.49% | 5.57 | 7.75 |
| | | 4 d | 5.26% | 4.48 | 7.70 |
| AB214-ADL1-D2-06 | 20 mM Histidine/ HOAc pH 6.0 | 0 d | 1.13% | 4.35 | 3.90 |
| | | 1 d | 1.57% | 4.45 | 3.89 |
| | | 2 d | 1.71% | 4.53 | 3.85 |
| | | 4 d | 3.39% | 4.55 | 3.87 |
| AB214-ADL1-D1-02 | 20 mM Histidine/ HOAc pH 6.0 | 0 d | 1.32% | 4.87 | 3.89 |
| | | 1 d | 1.39% | 4.93 | 3.92 |
| | | 2 d | 1.41% | 4.93 | 3.92 |
| | | 4 d | 3.59% | 5.06 | 3.92 |
| AB212-ADL1-D2-03 | 20 mM Histidine/ HOAc pH 6.0 | 0 d | 1.06% | 3.92 | 4.05 |
| | | 1 d | 1.42% | 3.93 | 4.04 |
| | | 2 d | 1.56% | 4.00 | 4.06 |
| | | 4 d | 4.48% | 3.68 | 4.06 |
| AB212-ADL1-D1-02 | 20 mM Histidine/ HOAc pH 6.0 | 0 d | 1.10% | 4.97 | 3.90 |
| | | 1 d | 1.24% | 5.02 | 3.90 |
| | | 2 d | 1.26% | 5.02 | 3.90 |
| | | 4 d | 4.82% | 4.47 | 3.87 |
| AB216-ADL1-D2-03 | 20 mM Histidine/ HOAc pH 6.0 | 0 d | 0.87% | 4.12 | 3.91 |
| | | 1 d | 0.92% | 4.15 | 3.92 |
| | | 2 d | 1.17% | 4.14 | 3.88 |
| | | 4 d | 1.92% | 4.18 | 3.92 |
| AB216-ADL1-D2-04 | 20 mM Histidine/ HOAc pH 6.0 | 0 d | 1.61% | 4.65 | 7.88 |
| | | 1 d | 2.83% | 4.67 | 7.86 |
| | | 2 d | 3.81% | 4.70 | 7.86 |
| | | 4 d | 6.72% | 4.88 | 7.83 |
| AB212-ADL1-D1-03 | 20 mM Histidine/ HOAc pH 6.0 | 0 d | 4.58% | 3.87 | 7.81 |
| | | 1 d | 5.02% | 3.90 | 7.87 |
| | | 2 d | 5.82% | 4.04 | 7.81 |
| | | 4 d | 10.13% | 3.77 | 7.78 |
| AB216-ADL1-D1-04 | 20 mM Histidine/ HOAc pH 6.0 | 0 d | 3.87 | 5.25 | 3.93 |
| | | 1 d | 3.91% | 5.27 | 3.96 |
| | | 2 d | 4.43 | 5.25 | 3.91 |
| | | 4 d | 7.38 | 5.29 | 3.97 |
| AB212-ADL1-D1-05 | 20 mM Histidine/ HOAc pH 6.0 | 0 d | 1.55% | 4.81 | 3.96 |
| | | 1 d | 1.63% | 4.89 | 3.96 |
| | | 2 d | 1.75% | 4.92 | 3.96 |
| | | 4 d | 3.00% | 5.13 | 3.96 |

4.5 Binding Characterization

Antibodies

Methods: To evaluate binding of exemplary anti-BCMA antibodies to human cells, dose-response binding experiments were conducted on cell lines expressing low, moderate, or high levels of BCMA on the cell surface. NCI-H929 ($BCMA^{high}$), OPM2 ($BCMA^{moderate}$), and Raji ($BCMA^{low}$) cells were grown under ATCC-recommended culture conditions, collected in a sterile laminar flow hood, pelleted at 1200 rpm for 5 min and the supernatant was decanted. The pellet was resuspended in flow cytometry buffer (1×PBS containing 2% (v/v) FBS) to a density of ~5.56×10$^4$ cells/mL and 90 µL of cell suspension was added to each well of a 96-well plate. Antibody or isotype control was added to the appropriate wells to a final volume of 10 µL and incubated in darkness at 4° C. for 1-2 hours. Following primary incubation, cells were centrifuged at 1200 rpm for 5 min and the supernatant removed. Cell pellets were washed three times by resuspension in 150 µL of flow cytometry buffer, centrifuged at 1200 rpm for 5 min, and the supernatant was decanted. After the final wash, cells were resuspended in flow cytometry buffer and incubated with a fluorescently labelled anti-human IgG1 secondary antibody in darkness on ice for 40-60 min. Cells were then centrifuged at 1200 rpm for 5 min and the pellets were washed exactly as before. After decanting of the final wash solution, cells were resuspended in flow cytometry buffer to a final density of 2×10$^4$ to 5×10$^4$ cell/mL and analyzed on a BD LSRFortessa instrument (Becton-Dickinson).

Figure 2:
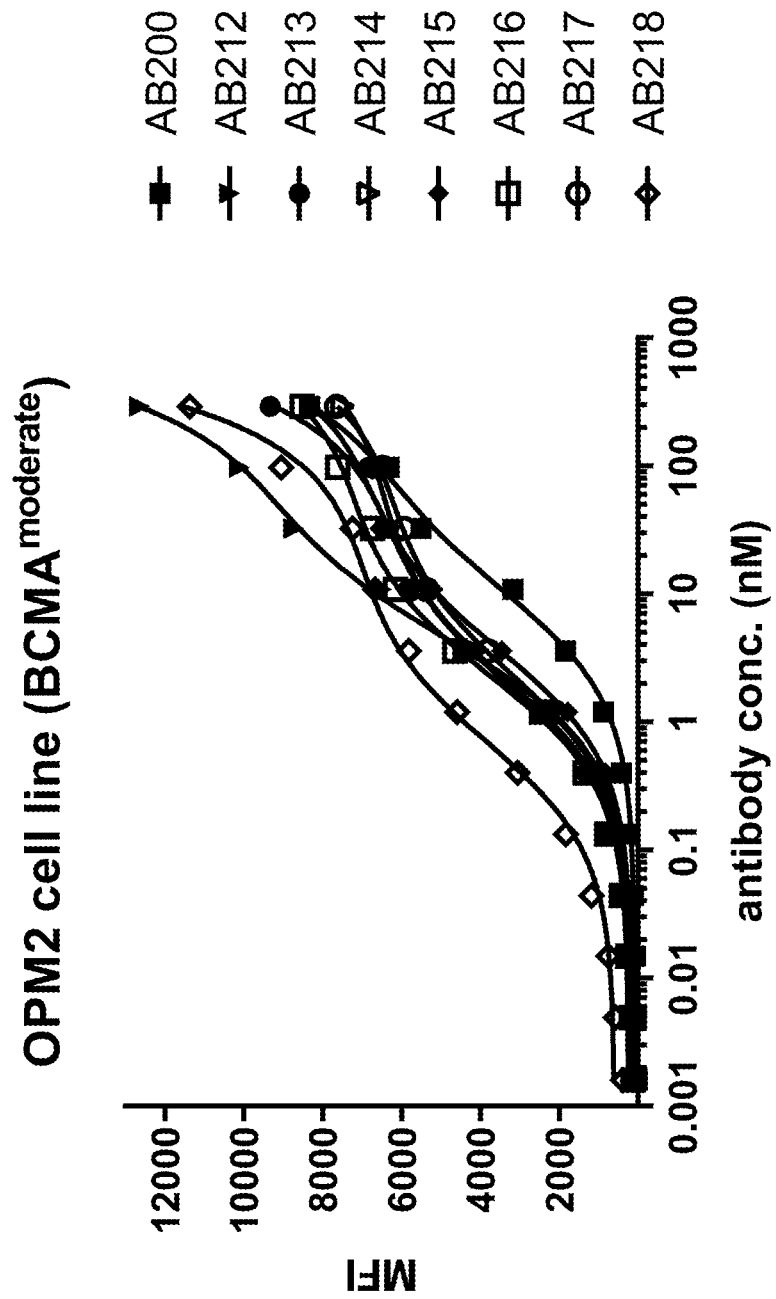
FIG. 2 shows a flow cytometric assessment of anti-BCMA antibody binding affinity on the OPM2 human myeloma cell line (moderate BCMA expression).
Figure 3:
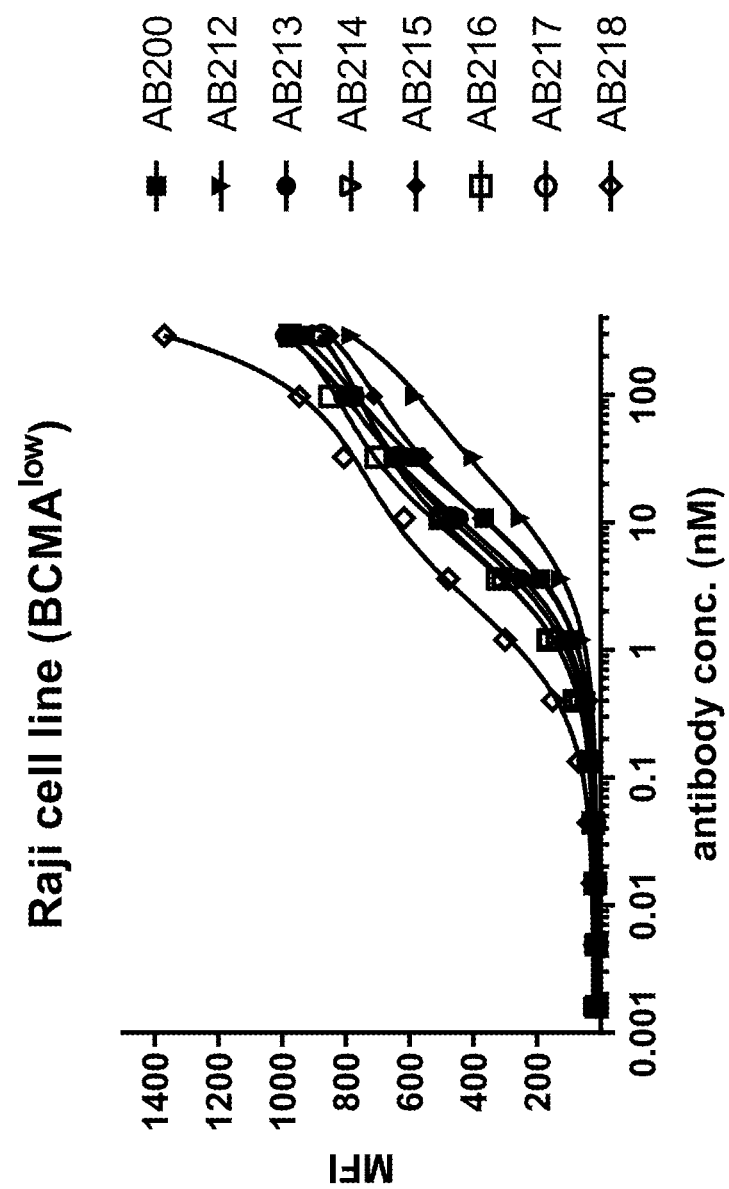
FIG. 3 shows a flow cytometric assessment of anti-BCMA ADC binding affinity on the Raji human Burkitt's lymphoma cell line (low BCMA expression).

Results: All seven exemplary antibody clones (AB212-AB218) bound to each cell line in a concentration-dependent manner (FIG. 1-3; Tables 22-24). Apparent $K_d$ for binding to each cell line was determined by flow cytometry, plotting the data in Prism (v8.0), and applying the 'One site-Total' curve fit equation. The AB200 antibody is shown as a reference and was included as a positive control for cell binding.

For each cell line tested, median fluorescence intensity (MFI) values increased with increasing antibody concentration, and the maximum MFI values for each cell line correlated with BCMA expression levels. Equilibrium dissociation constants ($K_d$) for all antibodies were calculated by non-linear curve fitting and are summarized in Tables 22-24. Rank-ordering of binding affinities for the anti-BCMA antibodies was similar for all three cell lines, with AB212 and AB218 showing the weakest and strongest binding, respectively.

TABLE 22

Anti-BCMA antibody binding affinity - NCI-H929

| Antibody clone ID | Apparent binding affinity ($K_d$, nM) | 95% CI (profile likelihood) |
|---|---|---|
| AB200 | 50.54 | 40.09 to 64.53 |
| AB212 | 9.682 | 8.855 to 10.59 |
| AB213 | 4.258 | 3.573 to 5.070 |
| AB214 | 2.84 | 2.331 to 3.455 |
| AB215 | 8.065 | 5.960 to 10.91 |
| AB216 | 3.048 | 2.686 to 3.458 |
| AB217 | 3.384 | 2.933 to 3.902 |
| AB218 | 0.9872 | 0.7403 to 1.312 |

TABLE 23

Anti-BCMA antibody binding affinity - OPM2

| Antibody clone ID | Apparent binding affinity ($K_d$, nM) | 95% CI (profile likelihood) |
|---|---|---|
| AB200 | 10.04 | 6.915 to 14.51 |
| AB212 | 4.326 | 3.530 to 5.298 |
| AB213 | 1.955 | 1.391 to 2.732 |
| AB214 | 2.118 | 1.791 to 2.502 |
| AB215 | 3.627 | 2.943 to 4.464 |
| AB216 | 2.267 | 1.863 to 2.757 |
| AB217 | 2.332 | 2.007 to 2.708 |
| AB218 | 0.6874 | 0.4578 to 1.031 |

TABLE 24

Anti-BCMA antibody binding affinity - Raji

| Antibody clone ID | Apparent binding affinity ($K_d$, nM) | 95% CI (profile likelihood) |
|---|---|---|
| AB200 | 13.97 | 12.06 to 16.21 |
| AB212 | 15.99 | 13.17 to 19.46 |
| AB213 | 8.828 | 8.107 to 9.613 |
| AB214 | 5.658 | 4.637 to 6.903 |
| AB215 | 11.22 | 10.37 to 12.14 |
| AB216 | 6.435 | 5.077 to 8.155 |
| AB217 | 7.307 | 6.194 to 8.619 |
| AB218 | 2.147 | 1.648 to 2.797 |

ADCs

Methods: NCI-H929 (BCMA$^{high}$) cells were grown under ATCC-recommended culture conditions, collected in a sterile laminar flow hood, pelleted at 1200 rpm for 5 min and the supernatant was decanted. The pellet was resuspended in flow cytometry buffer (1×PBS containing 2% (v/v) FBS) to a density of ~5.56×10$^4$ cells/mL and 90 µL of cell suspension was added to each well of a 96-well plate. ADC or isotype control antibody was added to the appropriate wells to a final volume of 10 µL and incubated in darkness at 4° C. for 1-2 hours. Following primary incubation, cells were centrifuged at 1200 rpm for 5 min and the supernatant removed. Cell pellets were washed three times by resuspension in 150 µL of flow cytometry buffer, centrifuged at 1200 rpm for 5 min, and the supernatant was decanted. After the final wash, cells were resuspended in flow cytometry buffer and incubated with a fluorescently labelled anti-human IgG1 secondary antibody in darkness on ice for 40-60 min. Cells were then centrifuged at 1200 rpm for 5 min and the pellets were washed exactly as before. After decanting of the final wash solution, cells were resuspended in flow cytometry buffer to a final density of 2×10$^4$ to 5×10$^4$ cell/mL and analyzed on a BD LSRFortessa instrument (Becton-Dickinson).

Figure 4:
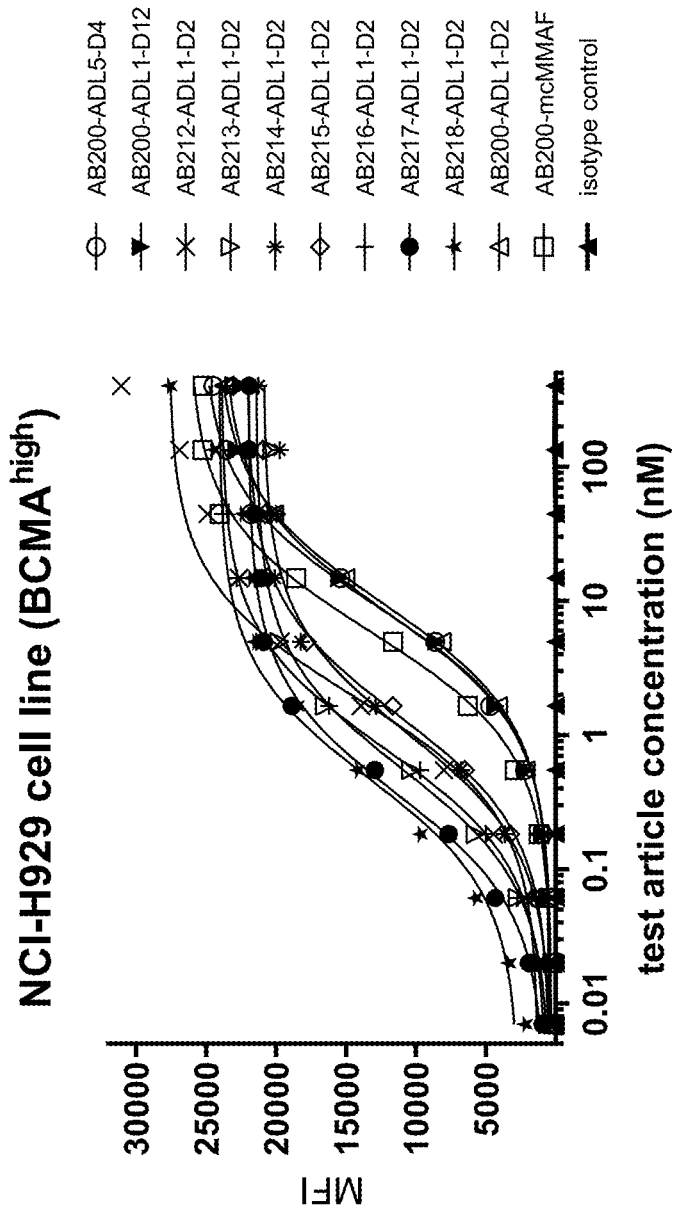
FIG. 4 shows a flow cytometric assessment of anti-BCMA ADC binding affinity on the NCI-H929 human myeloma cell line.

Results: To assess whether linker-payload conjugation altered the ability of anti-BCMA antibodies to bind BCMA-expressing cells, ADCs bearing the ADL1-D2 linker-payload were produced (average DAR ~4) for each of the seven exemplary antibody clones (AB212-AB218) discussed previously, and each was subjected to flow cytometry to quantify binding to the NCI-H929 human myeloma cell line. Four additional conjugates based on the AB200 reference antibody were included to explore the effects of various linker-payload combinations on cell binding. All four AB200 conjugates (three splicing modulator ADCs and one ADC bearing the mcMMAF linker-payload) bound to NCI-H929 cells with equilibrium dissociation constants of 6-10 nM (FIG. 4; Table 25). The AB200 ADC incorporating the ADL1-D2 linker-payload bound with a $K_d$ of ~9.7 nM (see Table 25 below). ADCs comprised of the same linker-payload (ADL1-D2) conjugated to each of the seven antibody clones bound with greater affinity than the AB200 ADC, the weakest and strongest of which demonstrated $K_d$ values of ~1.3 nM and ~0.33 nM, respectively. AB200-mcMMAF is also referred to interchangeably as AB200-ADL10-MMAF throughout the application.

TABLE 25

Anti-BCMA ADC binding affinity - NCI-H929

| Test article | Drug-to-antibody ratio (DAR) | Equilibrium dissociation constant ($K_d$), nM | 95% CI (profile likelihood) |
|---|---|---|---|
| AB200-ADL5-D4-05 | 4.39 | 9.8 | 7.862 to 12.20 |
| AB200-ADL1-D12-05 | 4.24 | 9.704 | 8.515 to 11.06 |
| AB200-ADL1-D2-02 | 3.92 | 9.659 | 8.296 to 11.24 |
| AB212-ADL1-D2-02 | 5.17 | 1.297 | 1.091 to 1.540 |
| AB213-ADL1-D2-02 | 4.18 | 0.5004 | 0.3587 to 0.6952 |
| AB214-ADL1-D2-02 | 4.12 | 1.025 | 0.7624 to 1.375 |
| AB215-ADL1-D2-02 | 3.96 | 1.297 | 1.008 to 1.667 |
| AB216-ADL1-D2-02 | 3.8 | 0.8364 | 0.7186 to 0.9730 |
| AB217-ADL1-D2-02 | 3.7 | 0.3663 | 0.2964 to 0.4520 |
| AB218-ADL1-D2-02 | 3.77 | 0.3325 | 0.2651 to 0.4167 |
| AB200-mcMMAF-05 | 4.0 | 6.504 | 5.478 to 7.717 |

4.6 Cell Viability

Anti-BCMA ADCs were tested in several BCMA-expressing cell lines for their ability to inhibit cell growth. NCI-H929 (ATCC, 5,000 cells/well), OPM2 (ATCC, 5,000 cells/well), MOLP8 (ATCC, 5,000 cells/well), and MM1.S (ATCC, 5,000 cells/well) cell lines were used.

Briefly, all cells and ADC solutions were prepared in a laminar flow hood under sterile conditions. For each cell line to be assayed, cells were resuspended in the appropriate medium supplemented with FBS to a density of 5.56×10$^4$ cells/mL. 90 µL of cell suspension was added to all wells of clear-bottom, black-wall, 96-well plates. For all test articles (anti-BCMA ADCs and reference ADCs), 10× stocks of the highest concentrations to be tested were prepared in 96-well plates and serially diluted 1:3 nine times to generate a 10-point curve. 10 µL of each 10× test article solution were added to the appropriate wells of the 96-well plates containing 90 µL of cells, and plates were placed in humidified incubators at 37° C. with 5% CO$_2$ for 6 days. Immediately after placing assay plates in the incubator, a single 96-well plate of cells was treated with CellTiter-Glo® reagent (Promega), incubated at room temperature for 10 min, and luminescence was quantified on an EnVision microplate reader. This plate served as a "time zero" reference and was used to interpret the data obtained after 6 days of incubation. Day-6 luminescence values less than those of the time zero plate were indicative of cell death, whereas signals less than the day-6 vehicle-treated cells but greater than the time zero signal were indicative of cytostatic activity. Non-linear curve fitting was performed and GI$_{50}$ and LD$_{50}$ values were obtained.

All tested ADCs were active in NCI-H929 and OPM2 cells. Activity generally improved when D1 and D2 were conjugated to AB212, AB213, AB214, AB215, AB216, AB217, and AB218, as compared to when the same payloads were conjugated to the reference antibody (e.g., AB200 conjugated to D1 or D2). Certain combinations of the exemplary antibodies with D1 or D2 were particularly active (e.g., AB214 combined with D2 was more active than D2 combined with other antibodies). In addition, combining certain linkers with certain payloads (e.g., ADL6 with D2) resulted in surprisingly increased potency in OPM2 cells (Table 26).

To evaluate whether the activity of anti-BCMA ADCs is antigen dependent, BCMA-negative Jurkat cells were treated. In BCMA-negative cells, none of the tested ADCs were as active when using the same concentrations that robustly targeted BCMA-positive cells (Table 26). These data suggest that the activity of the tested anti-BCMA ADCs is antigen dependent.

TABLE 26

Cell viability analysis of exemplary anti-BCMA ADCs

| SMLA Batch ID | HIC DAR | $GI_{50}$ (nM) OPM2.1 | $LD_{50}$ (nM) OPM2.1 | $GI_{50}$ (nM) MOLP8.1 | $LD_{50}$ (nM) MOLP8.1 | $GI_{50}$ (nM) MM1S.1 | $LD_{50}$ (nM) MM1S.1 | $GI_{50}$ (nM) NCIH929 | $LD_{50}$ (nM) NCIH929 | $GI_{50}$ (nM) Jurkat | $LD_{50}$ (nM) Jurkat |
|---|---|---|---|---|---|---|---|---|---|---|---|
| AB200-ADL1-D2-04 | 4.25 | 5.63 | 67.2 | ND | ND | ND | ND | ND | ND | 400 | 400 |
| AB200-ADL1-D1-02 | 7.9 | 0.587 | 2.39 | ND | ND | ND | ND | ND | ND | 400 | 400 |
| AB200-ADL1-D1-03 | 3.98 | 3.477 | 15.258 | ND | ND | ND | ND | ND | ND | 400 | 400 |
| AB216-ADL1-D1-02 | 7.69 | 0.166 | 0.68 | ND | ND | ND | ND | ND | ND | 400 | 400 |
| AB216-ADL1-D1-01 | 4.87 | 0.287 | 1.252 | ND | ND | ND | ND | ND | ND | 400 | 400 |
| AB216-ADL1-D1-04 | 4.01 | 0.62 | 2.921 | ND | ND | ND | ND | ND | ND | ND | ND |
| AB215-ADL1-D2-03 | 7.91 | 0.261 | 3.69 | ND | ND | ND | ND | ND | ND | 277.3 | 400 |
| AB216-ADL1-D2-02 | 3.8 | 1.562 | 14.009 | ND | ND | ND | ND | ND | ND | 400 | 400 |
| AB214-ADL21-D2-01 | ND | 1.008 | 14.353 | 3.286 | 33.504 | 0.316 | 25.443 | ND | ND | ND | ND |
| AB217-ADL1-D2-02 | 3.7 | 2.175 | 16.346 | ND | ND | ND | ND | ND | ND | ND | ND |
| AB218-ADL1-D2-02 | 3.77 | 0.985 | 19.826 | ND | ND | ND | ND | ND | ND | ND | ND |
| AB214-ADL1-D2-02 | 4.12 | 1.541 | 25.132 | 5.024 | 78.966 | 0.265 | 373.387 | ND | ND | ND | ND |
| AB212-ADL1-D1-02 | ND | 9.138 | 26.02 | ND | ND | ND | ND | ND | ND | ND | ND |
| AB215-ADL21-D2-03 | ND | 5.163 | 30.544 | ND | ND | ND | ND | ND | ND | 139.4 | 400 |
| AB216-ADL1-D2-03 | ND | 1.988 | 31.626 | ND | ND | ND | ND | ND | ND | ND | ND |
| AB213-ADL1-D2-02 | ND | 1.16 | 32.461 | 6.064 | 79.032 | 0.43 | 236.418 | ND | ND | ND | ND |
| AB213-ADL1-D2-01 | ND | 1.574 | 38.261 | 4.155 | 37.029 | 0.425 | 93.288 | ND | ND | ND | ND |
| AB217-ADL1-D2-01 | ND | 1.986 | 48.199 | 6.302 | 151.404 | 0.439 | 88.607 | 0.042 | 0.155 | ND | ND |
| AB212-ADL1-D2-01 | ND | 10.031 | 55.723 | 6.245 | 23.701 | 4.067 | 106.483 | 0.033 | 0.199 | ND | ND |
| AB215-ADL1-D2-02 | ND | 4.041 | 73.687 | 13.642 | 111.791 | 0.843 | 272.647 | ND | ND | ND | ND |
| AB212-ADL1-D2-02 | ND | 17.66 | 90.732 | 26.25 | 73.65 | 3.687 | 136.061 | ND | ND | ND | ND |
| AB218-ADL1-D2-01 | ND | 7.802 | 126.803 | 14.292 | 173.097 | 0.89 | >200.000 | <0.030 | 0.057 | ND | ND |
| AB214-ADL22-D2-01 | ND | 6.118 | 135.619 | ND | ND | ND | ND | ND | ND | ND | ND |
| AB212-ADL1-D1-04 | ND | 26.904 | 138.435 | ND | ND | ND | ND | ND | ND | ND | ND |
| AB212-ADL1-D2-03 | ND | 51.701 | 235.107 | ND | ND | ND | ND | ND | ND | 400 | 400 |
| AB212-ADL1-D2-05 | ND | 62.925 | 242.007 | ND | ND | ND | ND | ND | ND | ND | ND |
| AB215-ADL1-D2-01 | ND | 21.852 | 250.175 | 30.469 | 287.678 | 3.54 | >400.000 | <0.061 | 0.148 | ND | ND |
| AB212-ADL1-D1-05 | ND | 57.496 | 251.667 | ND | ND | ND | ND | ND | ND | 400 | 400 |
| AB216-ADL1-D2-01 | ND | 9.976 | 279.076 | 32.112 | >400.000 | 2.576 | >400.000 | 0.13 | 0.311 | ND | ND |
| AB216-ADL21-D1-01 | ND | 2.136 | 9.463 | ND | ND | ND | ND | ND | ND | ND | ND |
| AB216-ADL21-D2-01 | ND | 4.722 | 37.44 | ND | ND | ND | ND | ND | ND | 119.3894 | 400 |
| AB214-ADL1-D1-02 | ND | 0.718 | 5.032 | ND | ND | ND | ND | ND | ND | 400 | 400 |
| AB214-ADL1-D2-06 | ND | 3.102 | 29.262 | ND | ND | ND | ND | ND | ND | ND | ND |
| AB212-ADL1-D1-01 | ND | 29.091 | 136.084 | ND | ND | ND | ND | ND | ND | 292 | 400 |

TABLE 26-continued

Cell viability analysis of exemplary anti-BCMA ADCs

| SMLA Batch ID | HIC DAR | GI$_{50}$ (nM) OPM2.1 | LD$_{50}$ (nM) OPM2.1 | GI$_{50}$ (nM) MOLP8.1 | LD$_{50}$ (nM) MOLP8.1 | GI$_{50}$ (nM) MM1S.1 | LD$_{50}$ (nM) MM1S.1 | GI$_{50}$ (nM) NCIH929 | LD$_{50}$ (nM) NCIH929 | GI$_{50}$ (nM) Jurkat | LD$_{50}$ (nM) Jurkat |
|---|---|---|---|---|---|---|---|---|---|---|---|
| AB212-ADL1-D2-04 | ND | 85.835 | >400.000 | ND | ND | ND | ND | ND | ND | 400 | 400 |

ND = no data.

4.7 Freeze-Thaw Testing

Exemplary ADC samples (80 µL each, histidine/pH 6.0 buffer) were frozen at −80° C. for 2 hours. The samples were then placed at 22° C. for 30 min to remove visible ice. This completed one cycle. Sampling was performed at the starting point and after 1, 4, and 10 freeze-thaw cycles. 15 µL of each ADC was sampled each time, 7.5 µL of which was used to analyze DAR, aggregation, and concentration. Before analysis, all samples were stored at −80° C. Freeze-thaw data are shown in Table 27.

TABLE 27

Freeze-thaw testing of exemplary anti-BCMA ADCs

| | HIC DAR | | Concentration (mg/mL) | | Aggregation (%) | |
|---|---|---|---|---|---|---|
| ADC | Before freeze-thaw | After 6 freeze-thaw | Before freeze-thaw | After 6 freeze-thaw | Before freeze-thaw | After 6 freeze-thaw |
| AB214-ADL1-D2-06 | 3.91 | 3.90 | 4.42 | 4.35 | 1.10 | 1.13 |
| AB212-ADL1-D1-02 | 3.92 | 3.90 | 4.80 | 4.97 | 0.84 | 1.10 |
| AB216-ADL1-D2-03 | 3.93 | 3.91 | 4.17 | 4.12 | 0.90 | 0.87 |
| AB216-ADL1-D2-04- | 7.83 | 7.88 | 4.66 | 4.65 | 1.91 | 1.61 |
| AB216-ADL1-D2-02 | 3.80 | 3.81 | 4.91 | 4.92 | 0.89 | 0.65 |
| AB217-ADL1-D2-02 | 3.70 | 3.78 | 4.25 | 4.24 | 2.12 | 1.91 |
| AB218-ADL1-D2-02 | 3.77 | 3.75 | 4.68 | 4.86 | 0.10 | 0.39 |
| AB215-ADL1-D2-03 | 7.91 | 7.90 | 4.05 | 3.95 | 0.93 | 0.93 |
| AB215-ADL21-D2-03 | 4.04 | 4.01 | 4.31 | 4.27 | 0.68 | 0.74 |
| AB216-ADL21-D2-01 | 4.54 | 4.60 | 4.62 | 5.74 | 0.67 | 0.23 |
| AB216-ADL1-D1-01 | 4.87 | 4.88 | 4.67 | 4.93 | 0.80 | 1.09 |
| AB216-ADL1-D1-02 | 7.69 | 7.75 | 5.65 | 5.53 | 2.72 | 2.12 |
| AB214-ADL1-D1-02 | 3.91 | 3.89 | 4.90 | 4.87 | 2.01 | 1.32 |
| AB212-ADL1-D2-03 | 4.03 | 4.05 | 3.90 | 3.92 | 0.42 | 1.06 |
| AB212-ADL1-D1-02 | 3.92 | 3.90 | 4.80 | 4.97 | 0.84 | 1.10 |
| AB216-ADL1-D2-03 | 3.93 | 3.91 | 4.17 | 4.12 | 0.90 | 0.87 |
| AB216-ADL1-D2-04 | 7.83 | 7.88 | 4.66 | 4.65 | 1.91 | 1.61 |
| AB212-ADL1-D1-03 | 7.86 | 7.81 | 3.89 | 3.87 | 2.29 | 4.58 |
| AB216-ADL1-D1-04 | 4.01 | 3.91 | 5.22 | 5.25 | 2.94 | 3.87 |
| AB212-ADL1-D1-05 | 3.99 | 3.96 | 4.99 | 4.81 | 1.76 | 1.55 |

Example 5

To assess pre-mRNA splicing-related gene expression changes induced by treatment with anti-BCMA ADCs, three in vivo studies were conducted in xenograft models of multiple myeloma.

5.1 Methods

Two human myeloma cell lines, OPM2 and MOLP8, were subcutaneously inoculated into female CB17-Scid mice (5×10$^6$ cells/mouse), and tumors were allowed to reach ~300-500 mm$^3$ in volume prior to randomization into treatment groups. Mice were then randomly assigned to receive a single intravenous dose of either unconjugated reference antibody (AB200) or an anti-BCMA ADC. At predetermined time points after dosing, mice were euthanized according to institutionally approved protocols and tumor tissue was collected. Tumor fragments were then flash-frozen in liquid nitrogen or frozen following incubation in RNAlater preservation solution.

Figure 5:
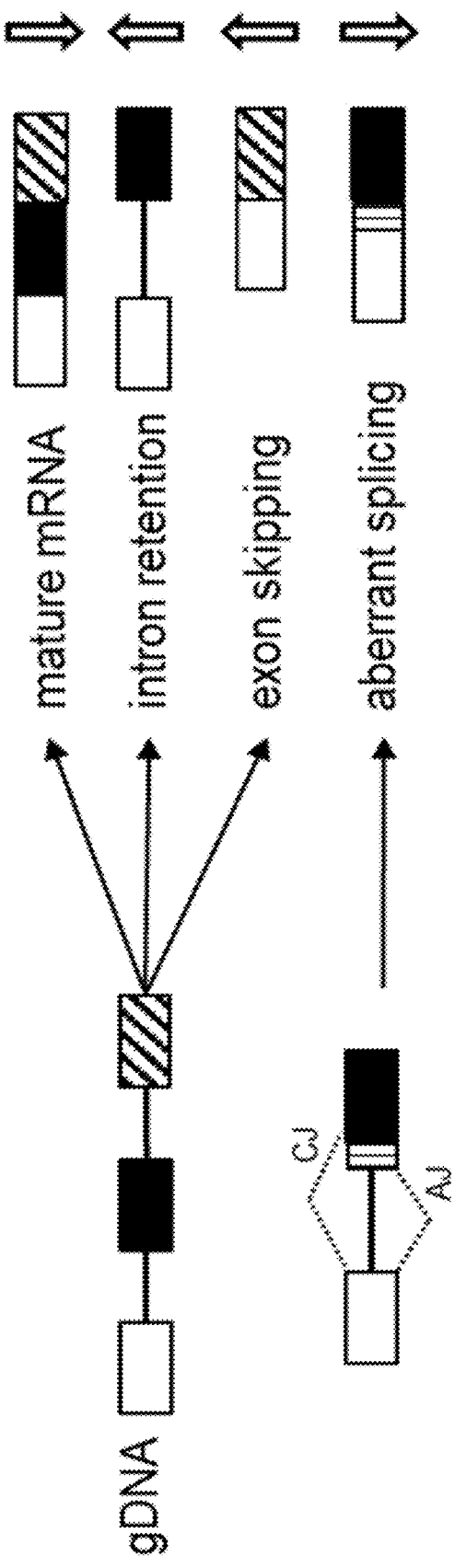
FIG. 5 shows potential mRNA splicing changes in genes affected by ADC treatment. Without wishing to be bound by theory, these potential mRNA splicing changes may include increased pre-mature mRNA (intron retention) accumulation, exon skipping events, and/or expression of aberrant junctions (AJ), with concomitant decreases in the expression of properly spliced (mature) mRNAs and mRNAs bearing canonical junctions (CJ).
Figure 6A:
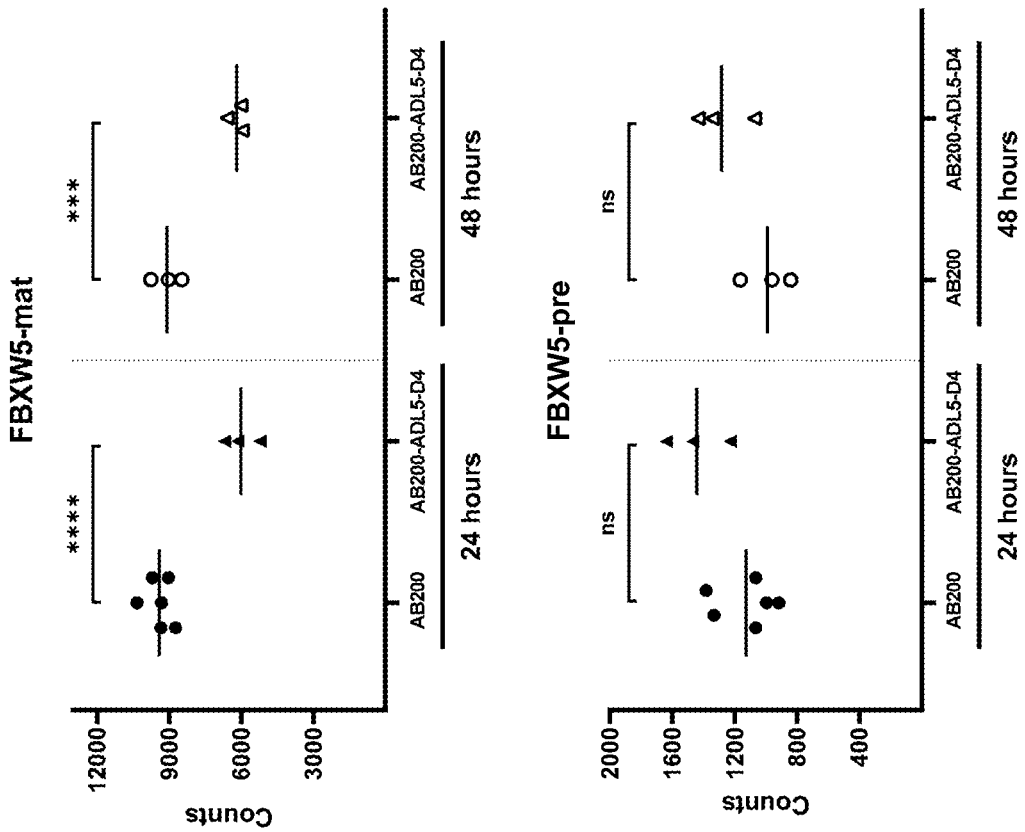
FIG. 6A-6D show mRNA splicing modulation of four exemplary genes (FBXW5 (FIG. 6A), PLEKHJ1 (FIG. 6B), DYNLT1 (FIG. 6C), and UBA2 (FIG. 6D)) in OPM2 tumors treated with AB200 antibody or AB200-ADL5-D4. Counts of mature mRNAs (FBXW5-mat, PLEKHJ1-mat, and DYNLT1-mat), pre-mRNA species (FBXW5-pre, PLEKHJ1-pre_2, and DYNLT1-pre), mRNAs with canonical splice sites (UBA2_CJ_1), and mRNAs with aberrant splice sites (UBA2_AJ_4) are shown.
Figure 6B:
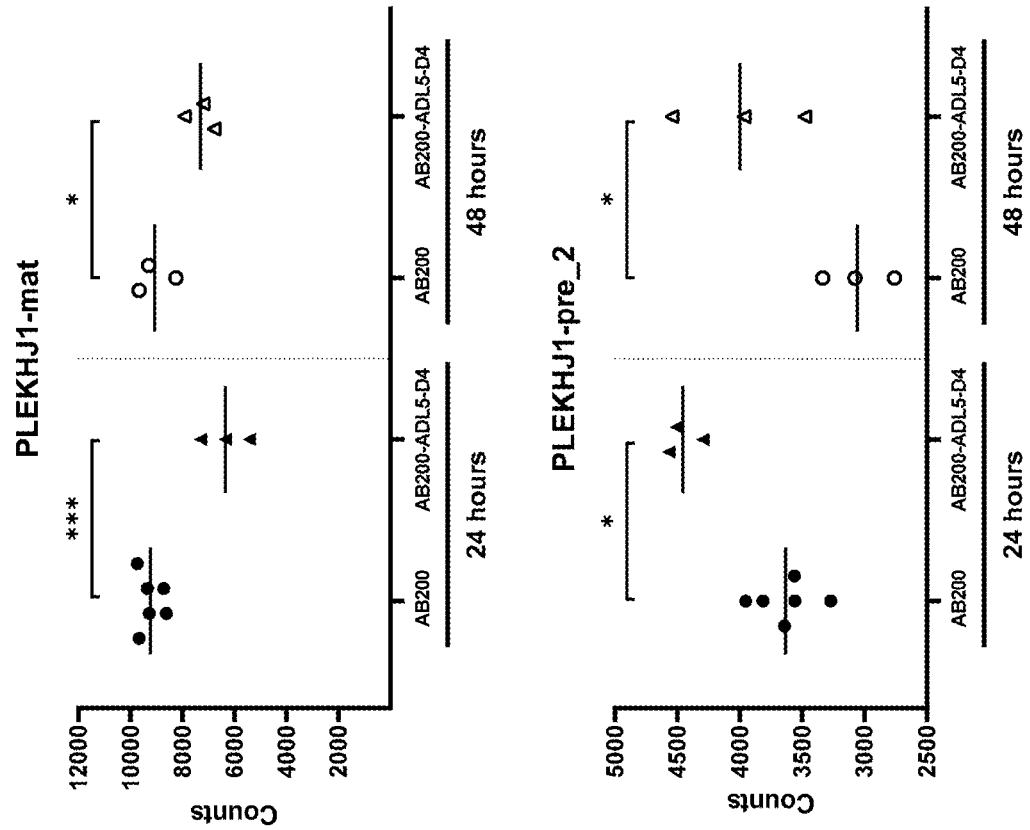
Figure 6C:
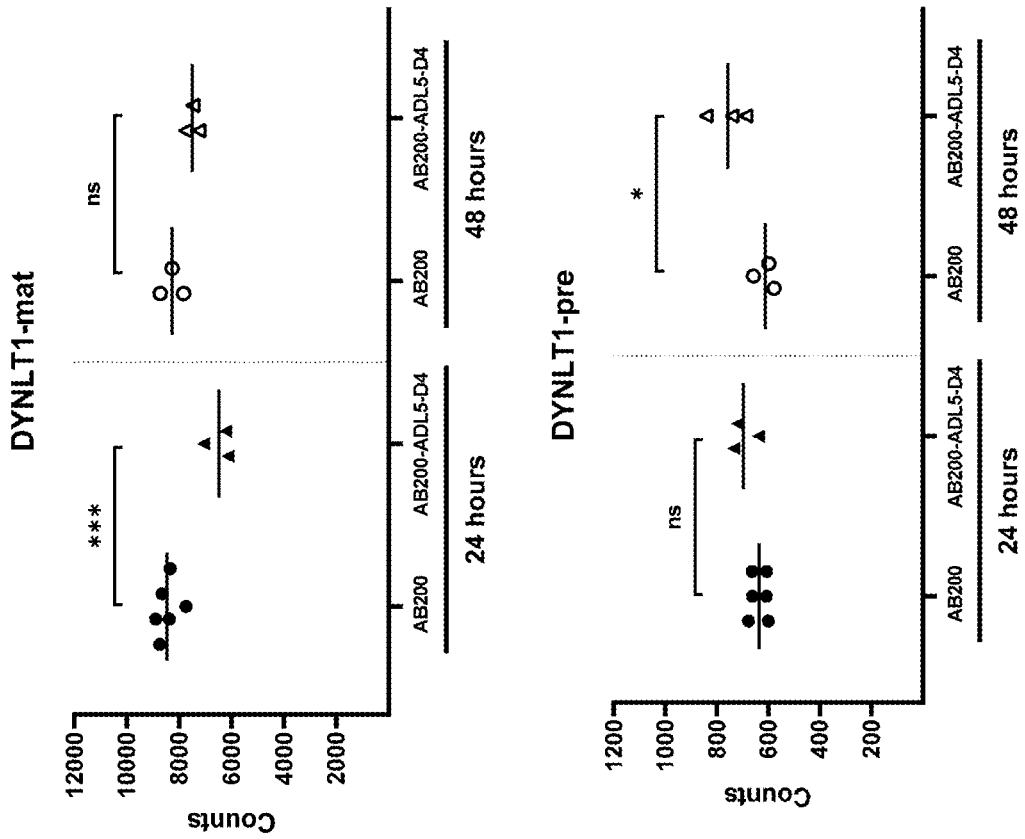
Figure 6D:
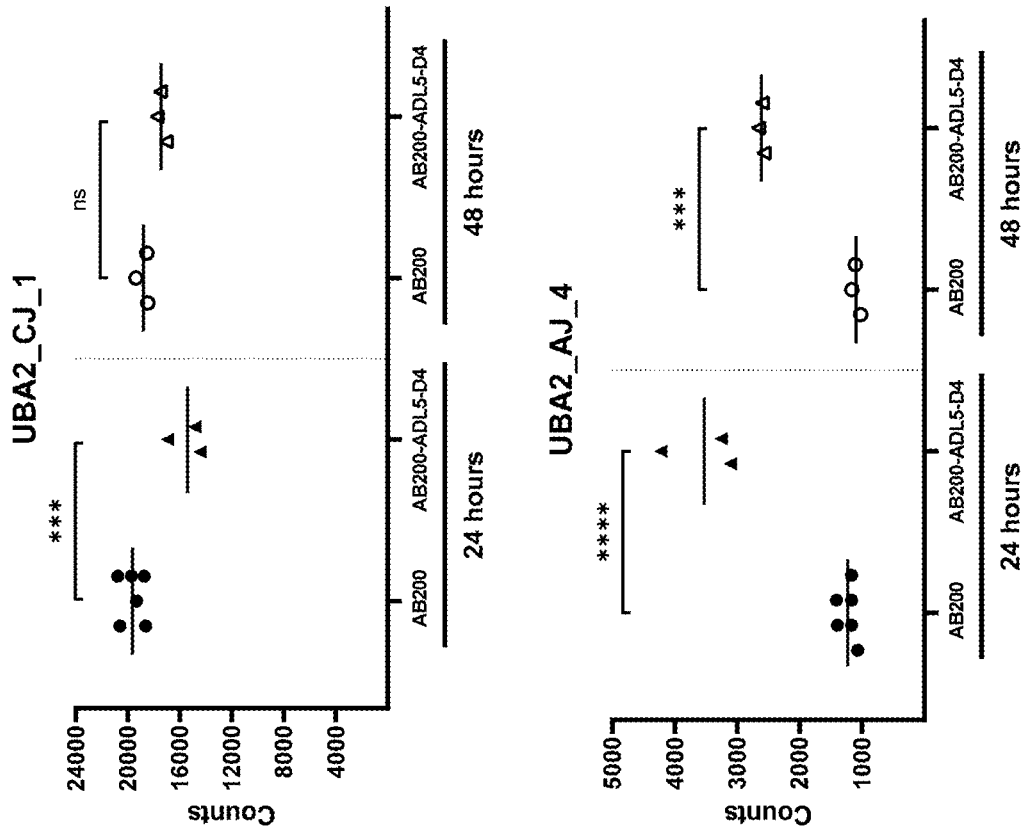
Figure 7A:
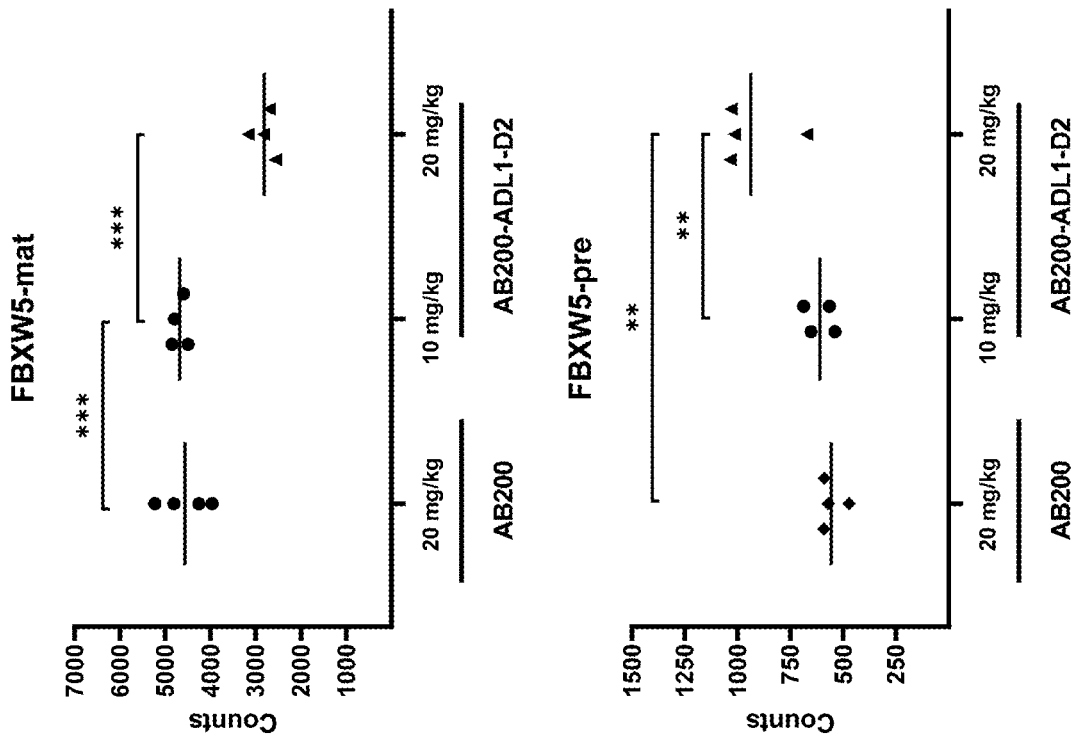
FIG. 7A-7D show mRNA splicing modulation of four exemplary genes (FBXW5, (FIG. 7A), PLEKHJI (FIG. 7B), DYNLTI (FIG. 7C), and UBA2 (FIG. 7D)) in MOLP8 tumors treated with AB200 antibody or AB200-ADL1-D2. Counts of mature mRNAs (FBXW5-mat, PLEKHJ1-mat, and DYNLT1-mat), pre-mRNA species (FBXW5-pre, PLEKHJ1-pre_2, and DYNLT1-pre), mRNAs with canonical splice sites (UBA2_CJ_1), and mRNAs with aberrant splice sites (UBA2_AJ_4) are shown.
Figure 7B:
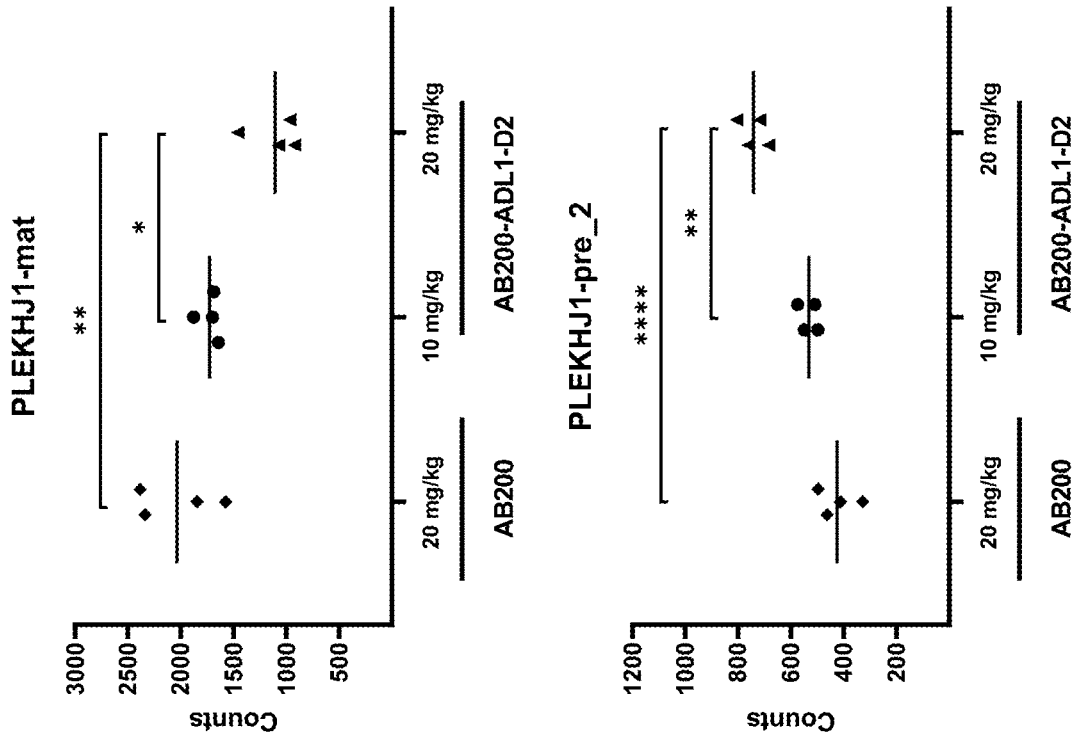
Figure 7C:
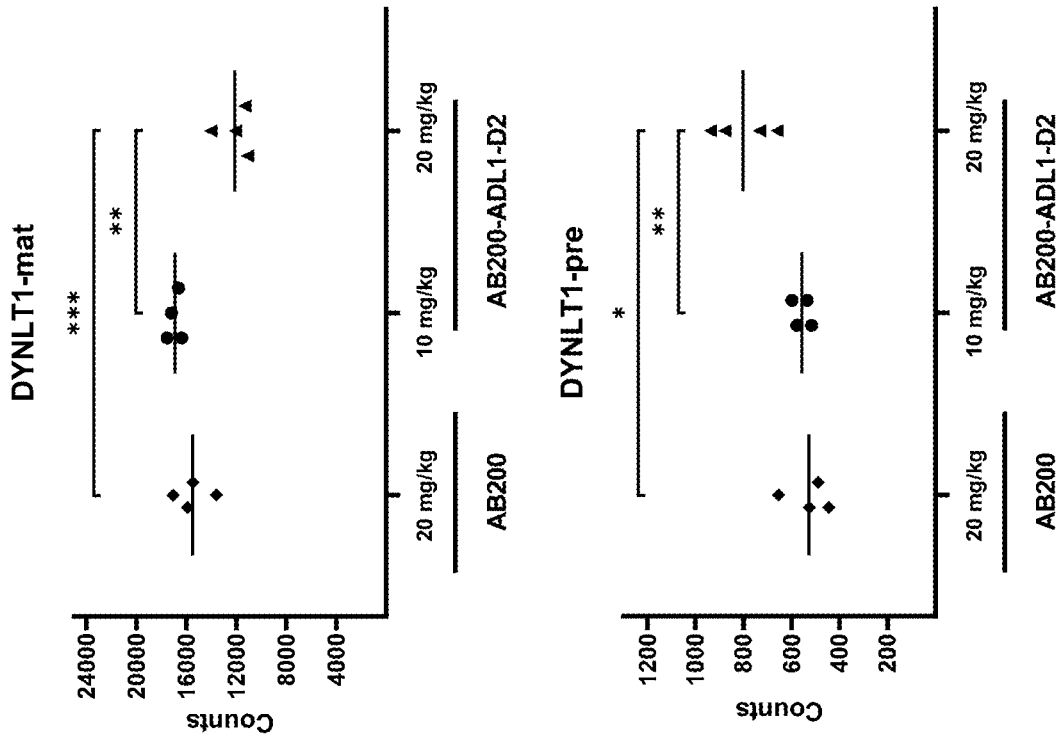
Figure 7D:
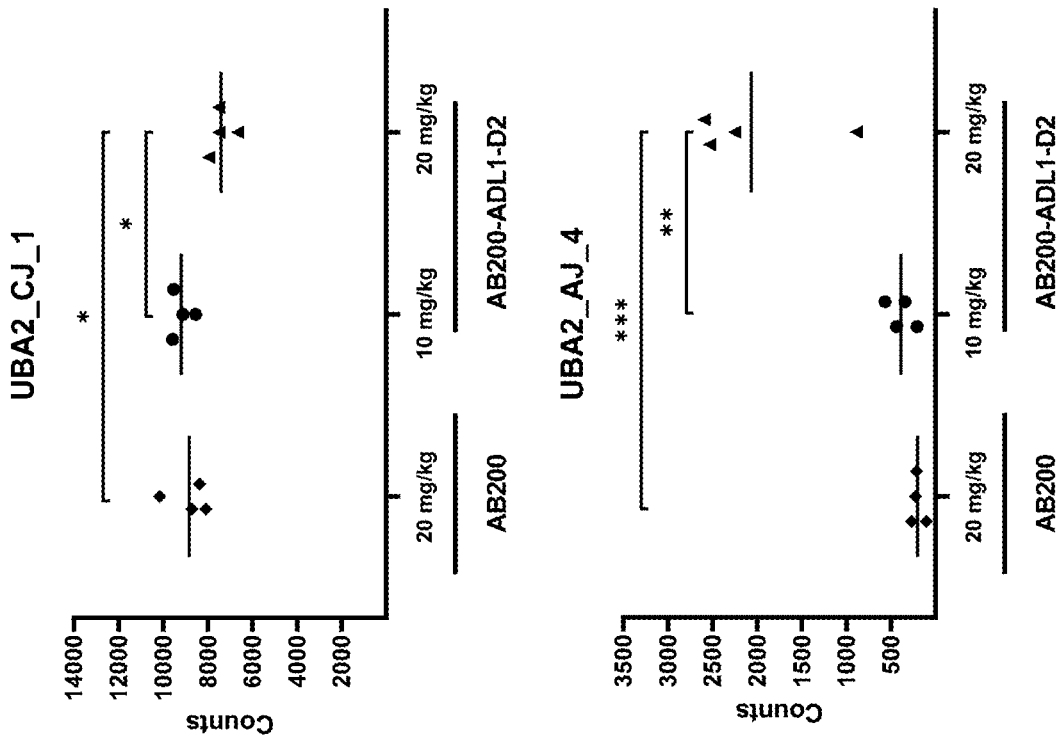
Figure 8A:
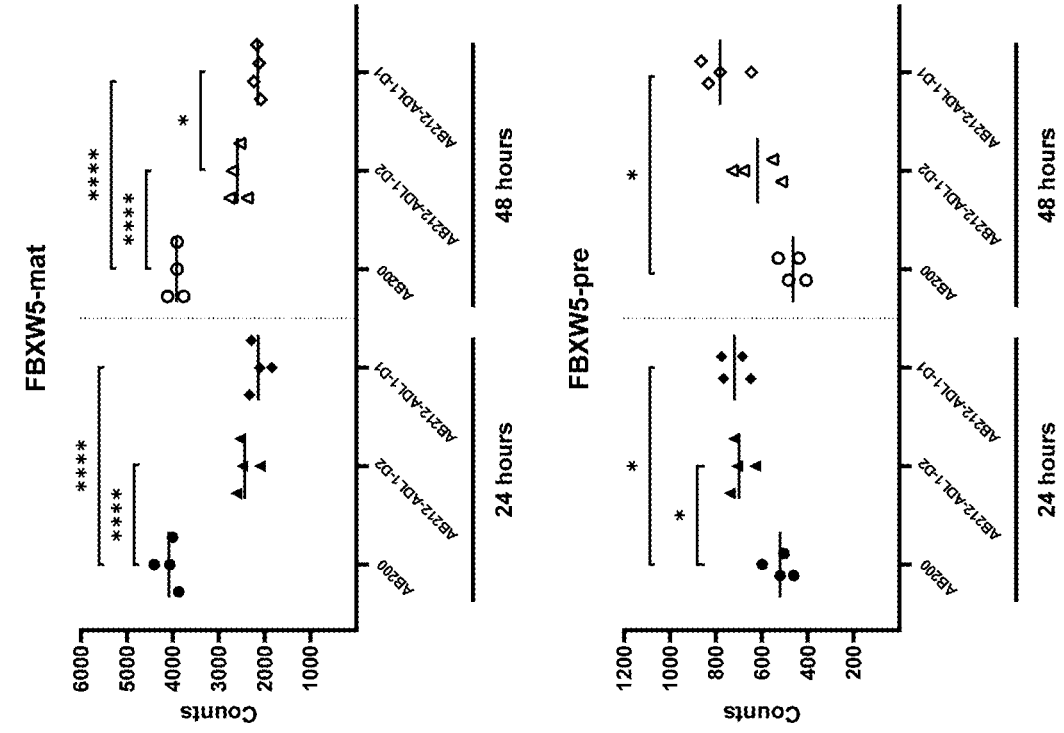
FIG. 8A-8D show mRNA splicing modulation of four exemplary genes (FBXW5, (FIG. 8A), PLEKHJI (FIG. 8B), DYNLTI (FIG. 8C), and UBA2 (FIG. 8D)) in OPM2 tumors treated with AB200 antibody, AB212-ADL1-D1, or AB212-ADL1-D2. Counts of mature mRNAs (FBXW5-mat, PLEKHJ1-mat, and DYNLT1-mat), pre-mRNA species (FBXW5-pre, PLEKHJ1-pre_2, and DYNLT1-pre), mRNAs with canonical splice sites (UBA2_CJ_1), and mRNAs with aberrant splice sites (UBA2_AJ_4) are shown.
Figure 8B:
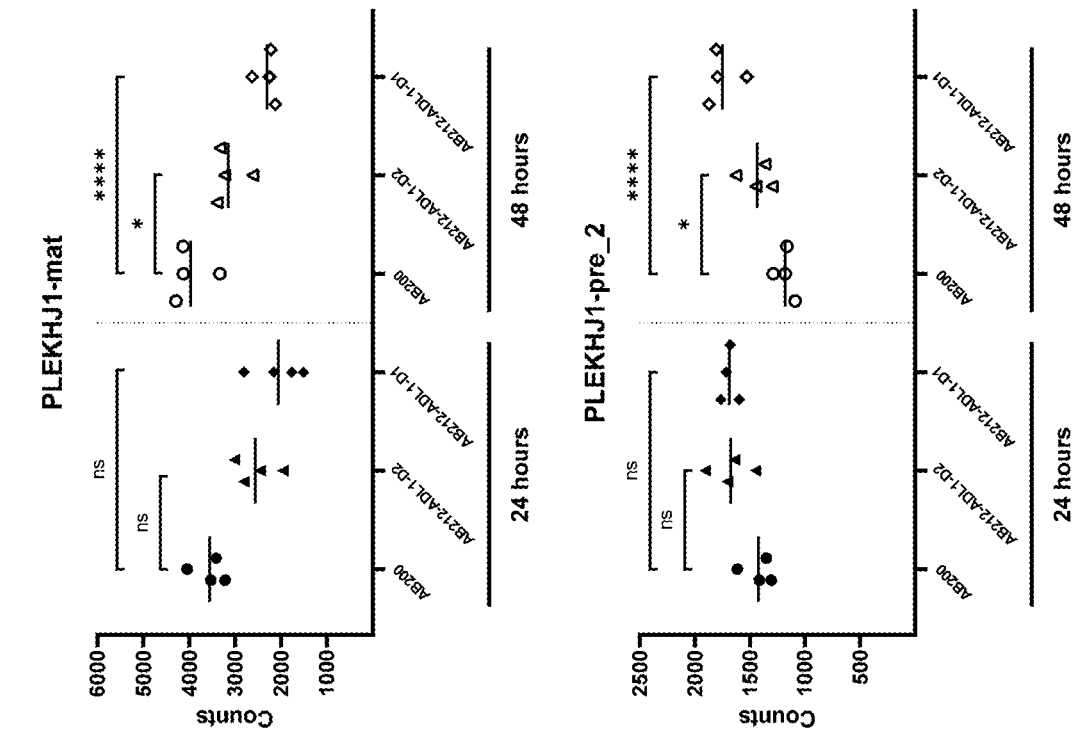
Figure 8C:
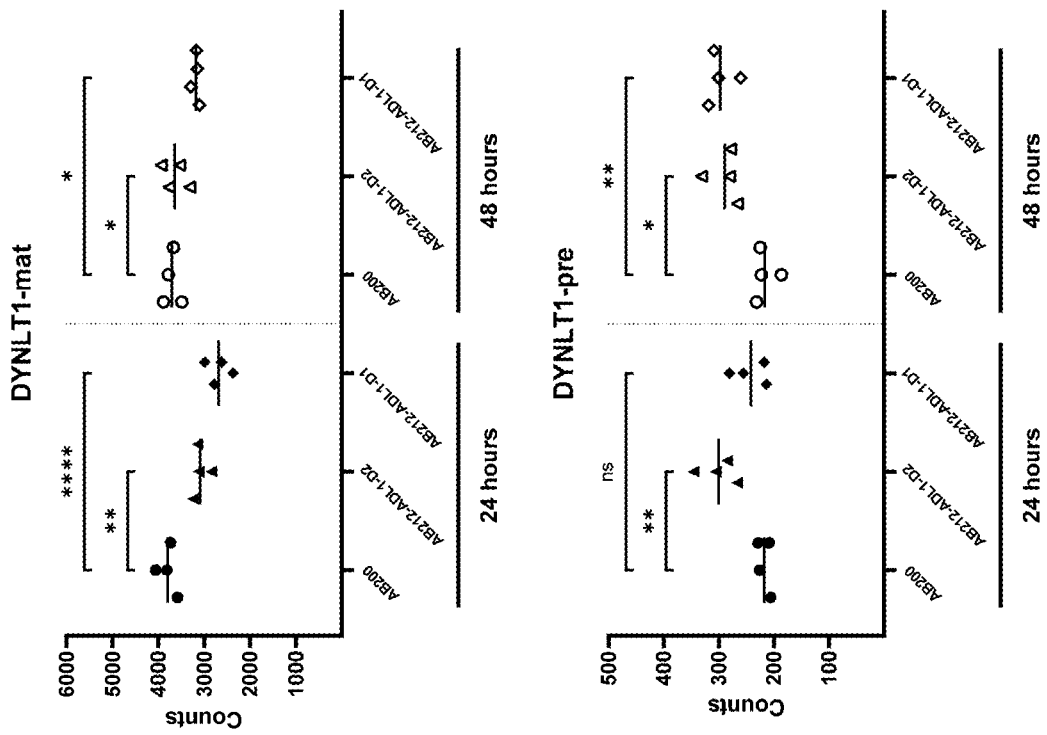
Figure 8D:
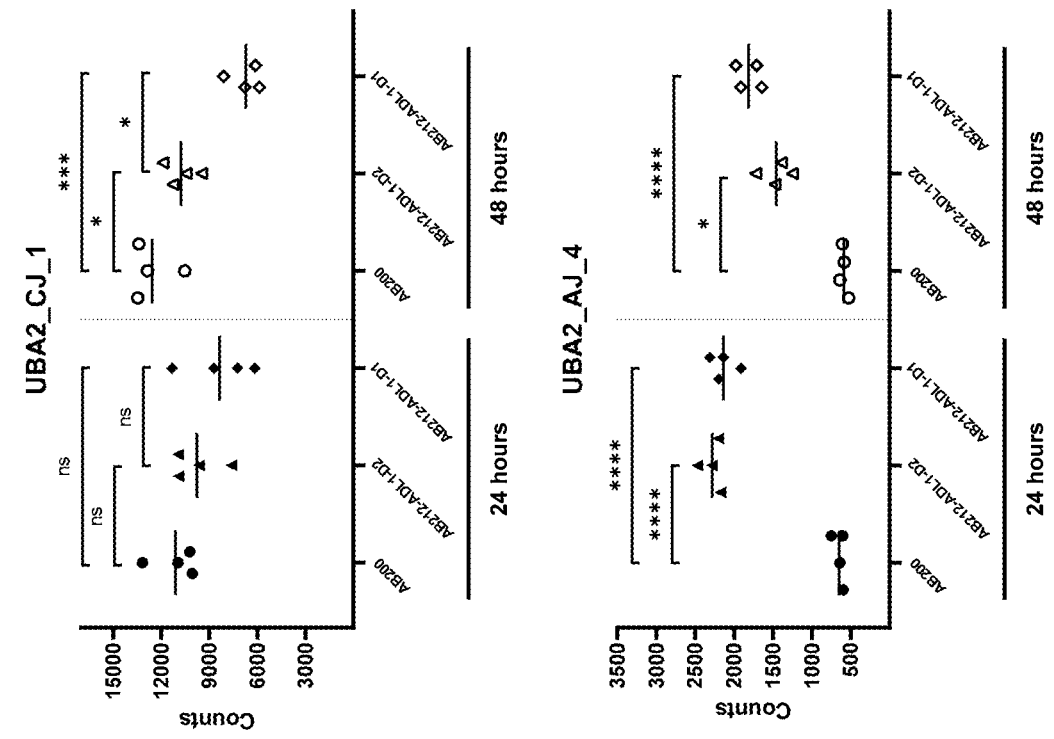

Total tumor RNA was isolated from tumor samples using the MagMAX™-96 for Microarrays Total RNA Isolation kit and MagMax instrument according to the manufacturer's instructions. RNA was quantified by UV absorbance on a NanoDrop spectrophotometer. Gene expression analysis was performed on the NanoString nCounter gene expression platform (NanoString Technologies). A custom code set consisting of a 70-gene panel with 61 genes to measure splicing changes induced by ADC and nine housekeeping genes was used (FIG. 5). For each sample, ~250 ng to 350 ng of total RNA in a final volume of 6.5 µL was mixed with custom gene expression Fusion TagSet including target specific oligonucleotides probe pairs A and B, the protector probe, fluorescently barcoded specific Reporter Tags, and biotinylated universal Capture Tag. Probes and target transcripts were hybridized overnight at 67° C. for 18 hours. Hybridized samples were run on the nCounter preparation station using the high-sensitivity protocol, in which excess Fusion TagSet was removed and transcript-specific ternary complexes were immobilized on a streptavidin-coated cartridge. The samples were scanned at maximum scan resolution on the nCounter Digital Analyzer as per the manufacturer's protocol. Gene expression data for each individual sample were normalized by background subtraction using the mean of the negative controls+2 standard deviations, positive control normalization using geometric mean of the positive controls, and code set content normalization using geometric mean of the housekeeping genes.

For statistical analysis, GraphPad Prism v7.0 software for Windows (GraphPad Software, Inc., CA, USA) was used. One-way ANOVA and Tukey-Kramer multiple comparisons tests were used to assess the splicing changes between the tumors treated with antibody or ADC and the level of significance was set at p<0.05. P-values are shown as * for <0.05,  for <0.01, * for <0.001, and **** for <0.0001.

5.2 Results

Three in vivo studies were performed to evaluate gene expression splicing changes in OPM2 and MOLP8 tumors following anti-BCMA ADC treatment.

In the first study, mice bearing OPM2 tumors were treated with a 10 mg/kg dose of unconjugated AB200 antibody or an ADC comprised of AB200 conjugated to the ADL5-D4 linker-payload (AB200-ADL5-D4) at an average DAR of ~4.0. Tumors were collected at 24 hours or 48 hours post-dose and total tumor RNAs were profiled with a custom splicing gene panel on the NanoString nCounter platform. At both time points, statistically significant splicing modulation was observed in ADC-treated (AB200-ADL5-D4) tumors relative to those treated with AB200 antibody alone, such as decreased expression of mature mRNAs (FBXW5-mat, PLEKHJ1-mat, and DYNLT1-mat), increased abundance of pre-mRNA species (PLEKHJ1-pre_2, and DYNLT1-pre), and decreased usage of canonical splice sites (UBA2_CJ_1) coupled with an increase in aberrant splice site usage (UBA2_AJ_4) (FIG. 6A-6D).

In the second study, splicing modulation of an anti-BCMA ADC was evaluated in a MOLP8 xenograft model, a model which has less cell surface expression of BCMA relative to OPM2. When normalized to a 20 mg/kg dose of AB200 alone, tumors treated with the AB200-ADL1-D2 ADC at 10 mg/kg showed no statistically significant changes in splicing for all junctions assessed using the custom NanoString panel. In contrast, a 20 mg/kg dose of the same ADC induced clear, statistically significant changes in intron retention and aberrant junction usage for several of the genes assessed (FIG. 7A-7D).

In the third study, splicing modulation of two exemplary anti-BCMA ADCs (ADCs comprised of an anti-BCMA antibody (AB212) conjugated to either the ADL1-D1 or ADL1-D2 linker-payload) was evaluated. OPM2 tumors were treated with a 20 mg/kg dose of each ADC, or with unconjugated AB200 antibody as a negative control, and splicing changes were assessed at 24 hours and 48 hours post-dose. At 24 hours, tumors from both ADC-treated groups showed clear, robust splicing changes relative to treatment with AB200 antibody alone. In tumors treated with AB212-ADL1-D1, the degree of splicing modulation observed at 24 hours was either maintained or modestly increased by 48 hours, whereas splicing modulation at the same time points in tumors treated with AB212-ADL1-D2 appeared to be returning to baseline for certain junctions (FIG. 8A-8D).

Example 6

To evaluate the anti-tumor activity of anti-BCMA antibodies and ADCs, in vivo studies were conducted in xenograft models of multiple myeloma.

6.1 Anti-BCMA Antibodies in OPM2 Xenograft Model Studies 1 and 2

Figure 9:
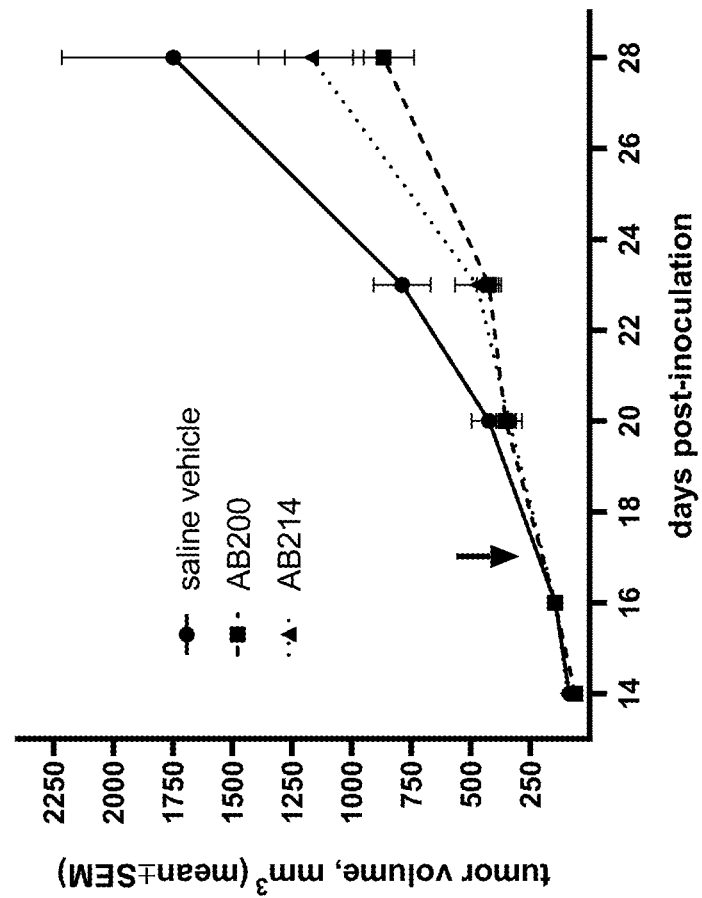
FIG. 9 shows in vivo anti-cancer activity of an exemplary anti-BCMA antibody (AB214) in an OPM2 xenograft model (study 1).
Figure 10:
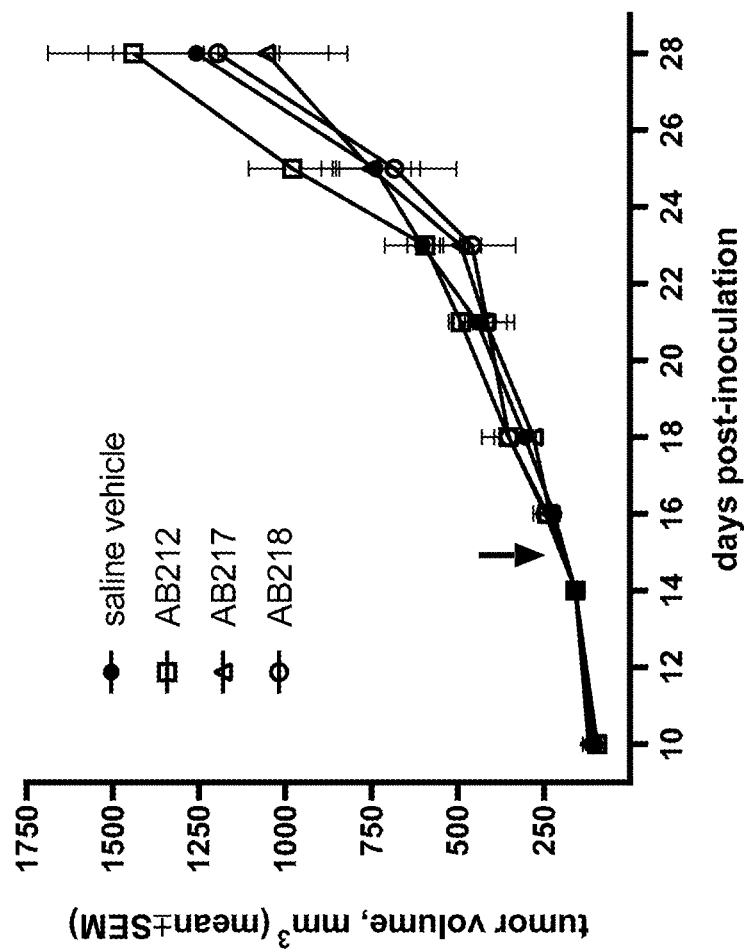
FIG. 10 shows in vivo anti-cancer activity of exemplary anti-BCMA antibodies (AB212, AB217, and AB218) in an OPM2 xenograft model (study 2).

Methods: Anti-tumor activity was assessed in an OPM2 multiple myeloma xenograft model for a subset of exemplary anti-BCMA antibodies in their naked (unconjugated) form. Four antibodies (AB212, AB214, AB217, and AB218) and a reference antibody (AB200) were tested, split between two studies. OPM2 cells were cultured and expanded for inoculation according to ATCC recommendations. Cells were pelleted and resuspended in a solution of serum-free RPMI-1640 medium (50% v/v) and Matrigel (50% v/v) at a density of $5.0 \times 10^7$ cells/mL. Female CB17-Scid mice were inoculated subcutaneously with 100 µL of cell suspension on their right flanks and monitored for tumor growth. When the mean tumor volume reached ~150 mm$^3$, mice were randomized into treatment groups and given a single intravenous dose (via tail vein) of 2.0 mg/mL dosing solution at 10 mL/kg for a total dose of 20 mg/kg (day of dosing is denoted by arrows in FIG. 9 and FIG. 10). Mice were weighed and their tumors were measured three times/week to monitor for any changes. Animals with tumors exceeding 2000 mm$^3$ or 20 mm in any dimension were taken off study and appropriately euthanized according to IACUC protocol. Upon euthanasia, tumor samples and serum were collected and banked for subsequent analyses.

The AB200 reference antibody induced ~50% tumor growth inhibition (TGI) at eleven days post-dose, but this effect was not statistically significant. Likewise, antibody clone AB214 reduced tumor growth by ~33%, but this effect was not statistically significant (FIG. 9; Table 28). In the second study, AB212, AB217, and AB218 each showed a modest effect on tumor growth, but these effects did not reach statistical significance (FIG. 10; Table 29). Taken together, these data suggest that the tested clones, when evaluated under the described experimental conditions, do not exhibit significant anti-tumor activity as unconjugated antibodies.

TABLE 28

In vivo activity (OPM2) - Study 1

| Treatment group | Tumor growth inhibition (%, day 28) | Day 28 p-value (vs. saline vehicle)** |
|---|---|---|
| saline vehicle | 0.0 | NA |
| AB200-02 | 50.45 | 0.2455 |
| AB214-02 | 33.11 | 0.5336 |

**Mixed-effects model with Tukey's correction

TABLE 29

In vivo activity (OPM2) - Study 2

| Treatment group | Tumor growth inhibition (%, day 28) | Day 28 p-value (vs. saline vehicle)** |
|---|---|---|
| saline vehicle | 0.0 | NA |
| AB212-01 | −14.50 | 0.8730 |
| AB217-01 | 16.14 | 0.9899 |
| AB218-01 | 4.93 | 0.9903 |

**Two-way ANOVA with Tukey's correction 6.2 Anti-BCMA ADCs in OPM2 Xenograft Model Studies 1 and 2

Methods: Anti-tumor activity of exemplary anti-BCMA ADCs was assessed in an OPM2 multiple myeloma xenograft model. OPM2 cells were cultured and expanded for inoculation according to ATCC recommendations. Cells were pelleted and resuspended in a solution of serum-free RPMI-1640 medium (50% v/v) and Matrigel (50% v/v) at a density of $5.0 \times 10^7$ cells/mL. Female CB17-Scid mice were inoculated subcutaneously with 100 µL of cell suspension on their right flanks and monitored for tumor growth. When the mean tumor volume reached ~150 mm$^3$, mice were randomized into treatment groups and given a single intravenous dose (via tail vein) of 2.0 mg/mL dosing solution at 10 mL/kg for a total dose of 20 mg/kg. Mice were weighed and their tumors were measured two to three times/week. Animals with tumors exceeding 2000 mm$^3$ or 20 mm in any dimension were taken off study and appropriately euthanized according to IACUC protocol. Upon euthanasia, tumor samples and serum were collected and banked for subsequent analyses.

Figure 11:
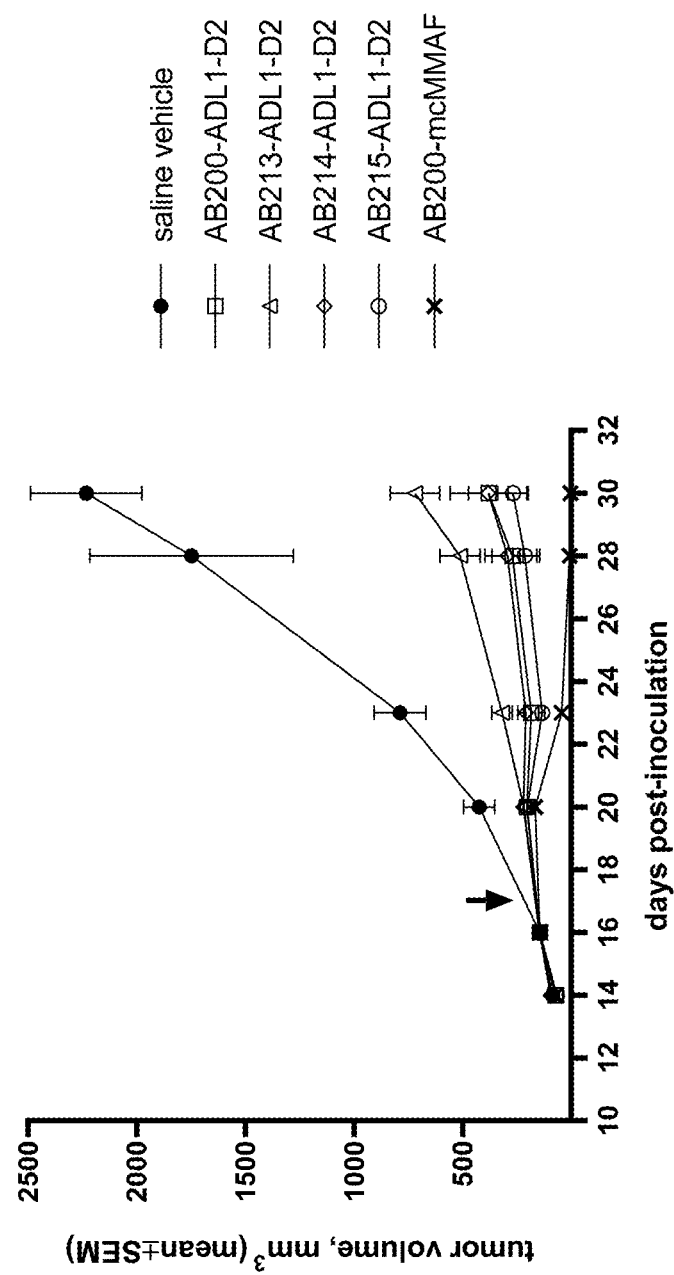
FIG. 11 shows in vivo anti-cancer activity of exemplary anti-BCMA ADCs in an OPM2 xenograft model (study 1).
Figure 12:
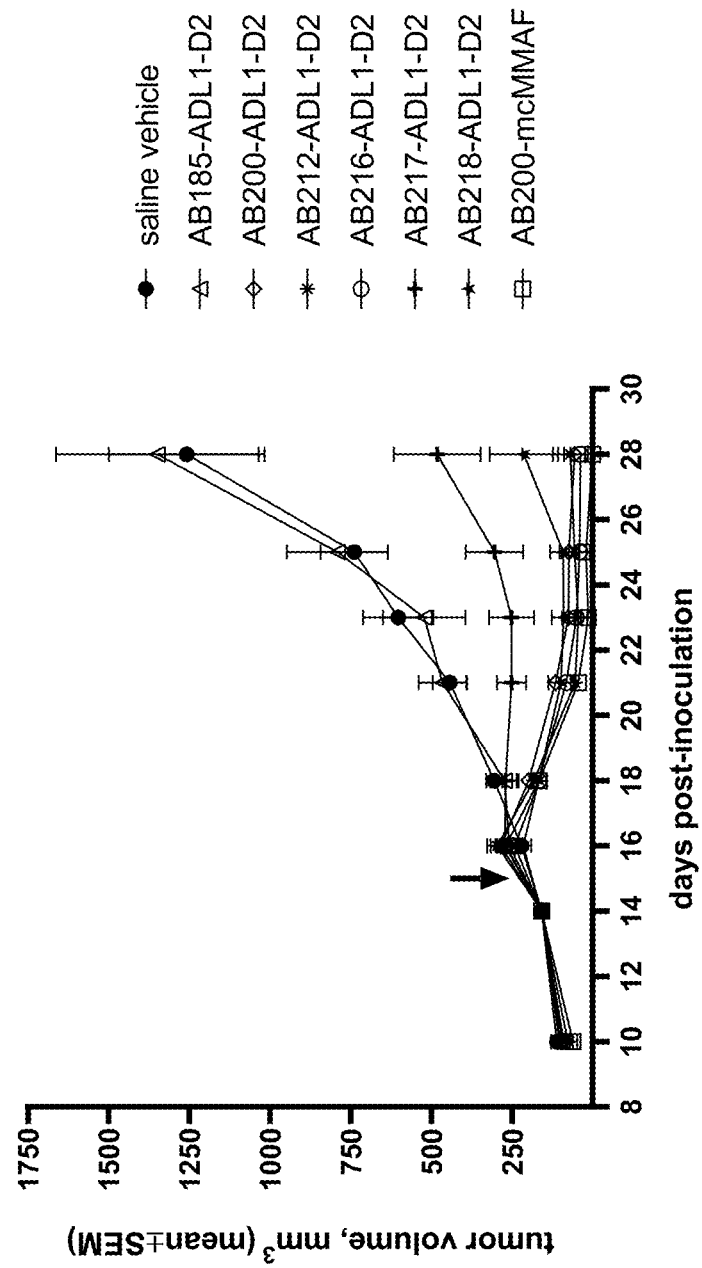
FIG. 12 shows in vivo anti-cancer activity of exemplary anti-BCMA ADCs in an OPM2 xenograft model (study 2).

Results: Seven clones were conjugated to the ADL1-D2 linker-payload by stochastic linkage to hinge cysteines at an average drug-to-antibody ratio (DAR) of ~4.0. The AB200 reference antibody conjugated to the mcMMAF linker-payload at an average DAR of 4 served as a positive control for anti-tumor activity; AB200 conjugated to the ADL1-D2 linker payload at a higher DAR (an average DAR of 7) was also included as a reference ADC. Conjugates of AB213, AB214, and AB215 were assessed in a first experiment (FIG. 11; Table 30); conjugates of AB212, AB216, AB217, and AB218 were assessed in a second experiment (FIG. 12; Table 31).

In the second experiment, to evaluate the antibody-specific activity of ADCs incorporating exemplary anti-BCMA antibodies, a 'non-targeting' ADC was generated by conjugating the ADL1-D2 linker-payload to the anti-HER2 antibody trastuzumab (AB185) at an average DAR of ~4.0. As the OPM2 cell line does not express HER2, the AB185-ADL1-D2 ADC was not expected to significantly inhibit OPM2 tumor growth. OPM2 tumors exposed to the non-targeting ADC showed indistinguishable growth relative to vehicle-treated tumors, suggesting that the anti-tumor activity demonstrated by the tested ADCs is dependent on the anti-BCMA antibodies employed.

TABLE 30

In vivo activity (OPM2) - Study 1

| Treatment group | Drug-to-antibody ratio (DAR) | Tumor growth inhibition (% ± SEM, day 30) | Day 30 p-value (vs. saline vehicle)** |
|---|---|---|---|
| saline vehicle | NA | 0.0 | NA |
| AB200-ADL1-D2-03 | 6.87 (RP) | 82.95 ± 7.92 | 0.0042 |
| AB213-ADL1-D2-02 | 4.18 (HIC) | 67.78 ± 5.08 | 0.0155 |
| AB214-ADL1-D2-02 | 4.12 (HIC) | 82.91 ± 4.07 | 0.0073 |
| AB215-ADL1-D2-02 | 3.96 (HIC) | 87.96 ± 3.18 | 0.0067 |
| AB200-mcMMAF-06 | 4.0 (HIC) | 99.83 ± 0.169 | 0.0058 |

**Mixed-effects model with Tukey's correction; NA, not applicable

TABLE 31

In vivo activity (OPM2) - Study 2

| Treatment group | Drug-to-antibody ratio (DAR) | Tumor growth inhibition (% ± SEM, day 28) | Day 28 p-value (vs. saline vehicle)** |
|---|---|---|---|
| saline vehicle | NA | 0.0 | NA |
| AB185-ADL1-D2-05 | 4.33 (HIC) | -7.3 ± 24.99 | >0.9999 |
| AB200-ADL1-D2-04 | 4.25 (HIC) | 95.48 ± 2.63 | 0.0375 |
| AB212-ADL1-D2-02 | 5.17 (HIC) | 94.53 ± 4.34 | 0.0373 |
| AB216-ADL1-D2-02 | 3.8 (HIC) | 96.99 ± 1.90 | 0.0357 |
| AB217-ADL1-D2-02 | 3.7 (HIC) | 61.69 ± 10.68 | 0.2186 |
| AB218-ADL1-D2-02 | 3.77 (HIC) | 83.00 ± 8.44 | 0.0618 |
| AB200-mcMMAF-05 | 4.0 (HIC) | 100 ± 0 | 0.0322 |

**Two-way ANOVA with Tukey's correction; NA, not applicable

Study 3

Methods: To evaluate the in vivo efficacy of exemplary linker-payloads in anti-BCMA ADCs, the AB212 antibody was conjugated to the ADL1-D1 or ADL1-D2 linker-payloads, targeting an average DAR of 4.0 (a DAR of 3.84 was achieved for both AB212 ADCs). Female CB17-Scid mice bearing OPM2 xenografts were randomized into groups of ten (average tumor volume of ~125 mm$^3$/group) and given a single intravenous tail vein injection of test article. Each ADC was dosed at either 5 or 10 mg/kg. AB200-mcMMAF served as a positive control for anti-tumor activity and was dosed at 10 mg/kg, given once by intravenous tail vein injection.

Figure 13:
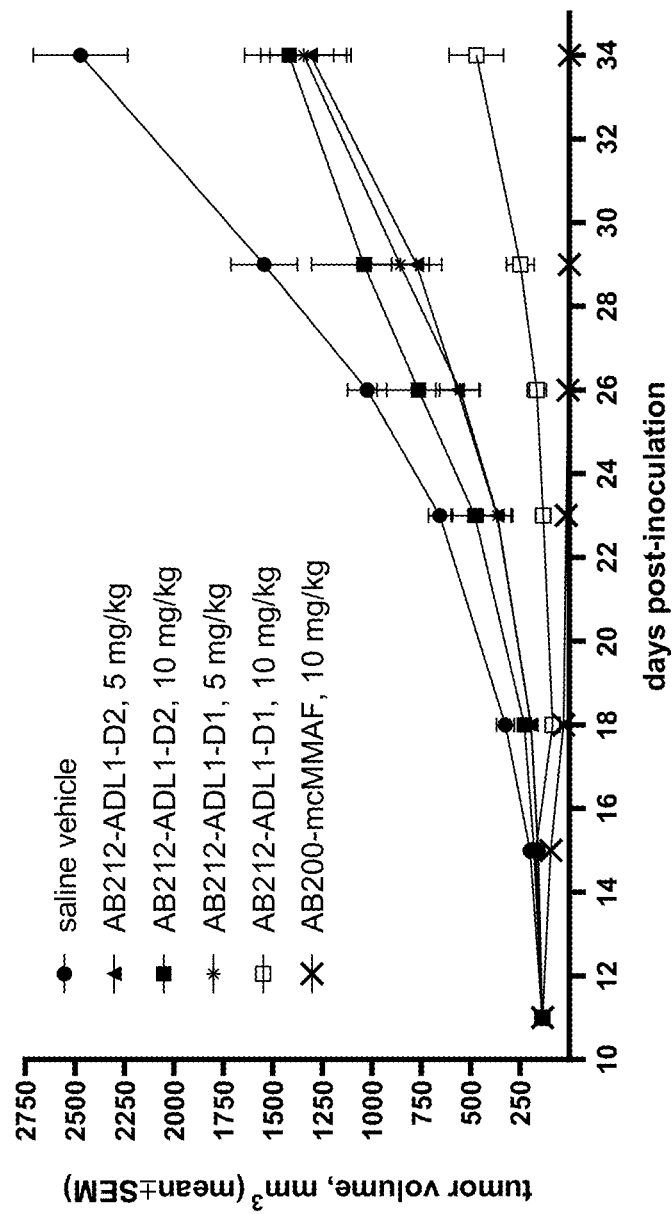
FIG. 13 shows in vivo anti-cancer activity of exemplary anti-BCMA ADCs in an OPM2 xenograft model (study 3).

Results: When dosed at 5 mg/kg, no statistically significant difference between the anti-tumor activity of ADCs bearing the ADL1-D1 and ADL1-D2 linker-payloads was observed (FIG. 13; Table 32). In contrast, when dosed at 10 mg/kg, the ADC bearing the ADL1-D1 linker-payload exhibited increased efficacy as compared to the ADC bearing the ADL1-D2 linker-payload (p-value=0.0308).

TABLE 32

In vivo activity (OPM2) - Study 3

| Treatment group | Drug-to-antibody ratio (DAR) | Tumor growth inhibition (% ± SEM, day 34) | Day 34 p-value (vs. saline vehicle)** |
|---|---|---|---|
| saline vehicle | NA | 0.0 | NA |
| AB212-ADL1-D2-05, 10 mg/kg | 3.84 (HIC) | 42.63 ± 9.12 | 0.0554 |
| AB212-ADL1-D2-05, 5 mg/kg | 3.84 (HIC) | 47.01 ± 8.32 | 0.0227 |
| AB212-ADL1-D1-04, 10 mg/kg | 3.84 (HIC) | 80.92 ± 5.60 | 0.0002 |
| AB212-ADL1-D1-04, 5 mg/kg | 3.84 (HIC) | 45.64 ± 8.78 | 0.0317 |
| AB200-mcMMAF-07, 10 mg/kg | 4.03 (HIC) | 100 ± 0 | 0.0002 |

Day 34 p-value (10 mg/kg ADL1-D2 ADC vs. 10 mg/kg ADL1-D1 ADC)** = 0.0308
**Mixed-effects model with Tukey's correction; NA, not applicable Study 4

Methods: To evaluate the in vivo efficacy of exemplary antibodies in anti-BCMA ADCs, the AB212 and AB216 antibodies were conjugated to the ADL1-D1 linker-payload, targeting an average DAR of 4.0 (DARs of 3.92 and 4.01 were achieved for the AB212 and AB216 ADCs, respectively). Female CB17-Scid mice bearing OPM2 xenografts were randomized into groups of ten (average tumor volume of ~125 mm$^3$/group) and given a single intravenous tail vein injection of test article. Each ADC was dosed at either 5 or 10 mg/kg. AB200-mcMMAF served as a positive control for anti-tumor activity and was dosed at 10 mg/kg, given once by intravenous tail vein injection. All mice remaining on day 108 post-inoculation were euthanized according to approved institutional protocols. Serum was collected and frozen for future analyses.

Figure 14:
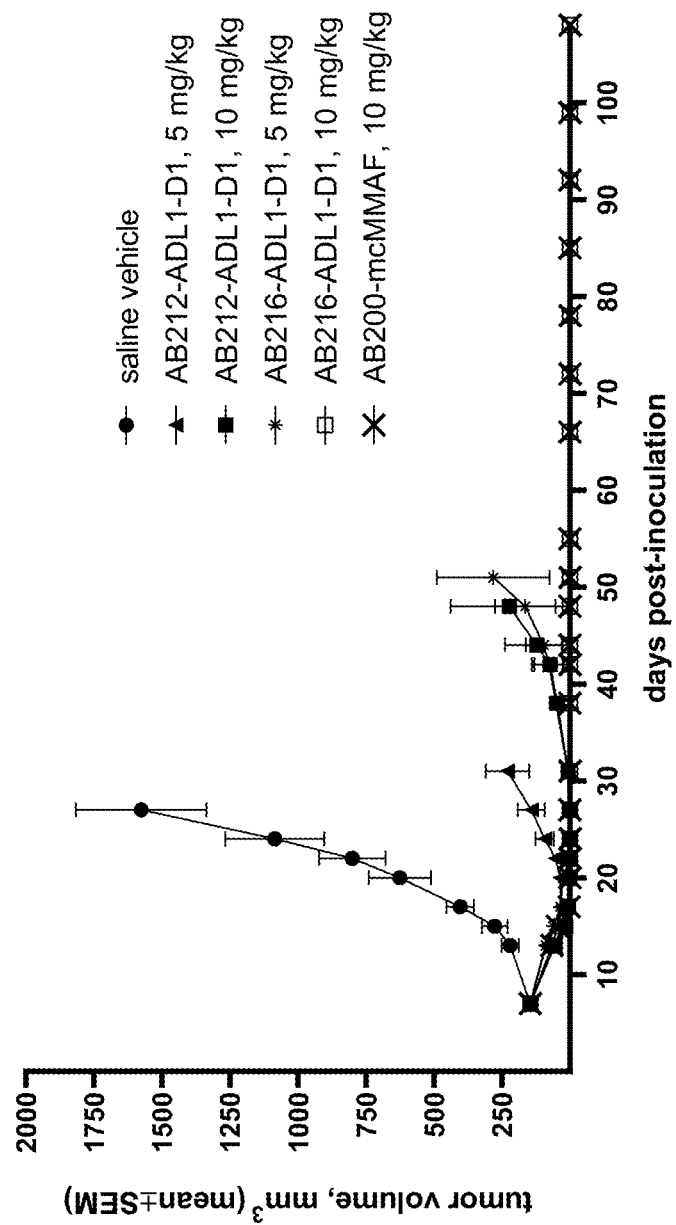
FIG. 14 shows in vivo anti-cancer activity of exemplary anti-BCMA ADCs in an OPM2 xenograft model (study 4).

Results: For approximately two weeks following administration, all four ADC groups and the AB200-mcMMAF control showed indistinguishable activity, inducing deep regressions in all tumors (FIG. 14; Table 33). However, continued monitoring revealed the regrowth of several tumors in the 5 mg/kg AB212 ADC group. Subsequently, tumors began to regrow in the 10 mg/kg AB212 ADC and 5 mg/kg AB216 ADC groups, whereas all mice in the 10 mg/kg AB216 ADC group remained tumor-free for the duration of the study (100 days post-dose), as did all mice in the AB200-mcMMAF control group (see FIG. 14).

TABLE 33

In vivo activity (OPM2) - Study 4

| Treatment group | Drug-to-antibody ratio (DAR) | Tumor growth inhibition (% ± SEM, day 27) | Day 27 p-value (vs. saline vehicle)** |
|---|---|---|---|
| saline vehicle | NA | 0.0 | NA |
| AB212-ADL1-D1-02, 10 mg/kg | 3.92 (HIC) | 100 ± 0 | 0.0016 |
| AB212-ADL1-D1-02, 5 mg/kg | 3.92 (HIC) | 90.95 ± 3.15 | 0.0027 |
| AB216-ADL1-D1-04, 10 mg/kg | 4.01 (HIC) | 100 ± 0 | 0.0016 |
| AB216-ADL1-D1-04, 5 mg/kg | 4.01 (HIC) | 99.78 ± 0.22 | 0.0017 |
| AB200-mcMMAF-07, 10 mg/kg | 4.03 (HIC) | 100 ± 0 | 0.0016 |

**Mixed-effects model with Tukey's correction; NA, not applicable 6.3 Anti-BCMA ADCs in MOLP8 Xenograft Model Study 1

Figure 15:
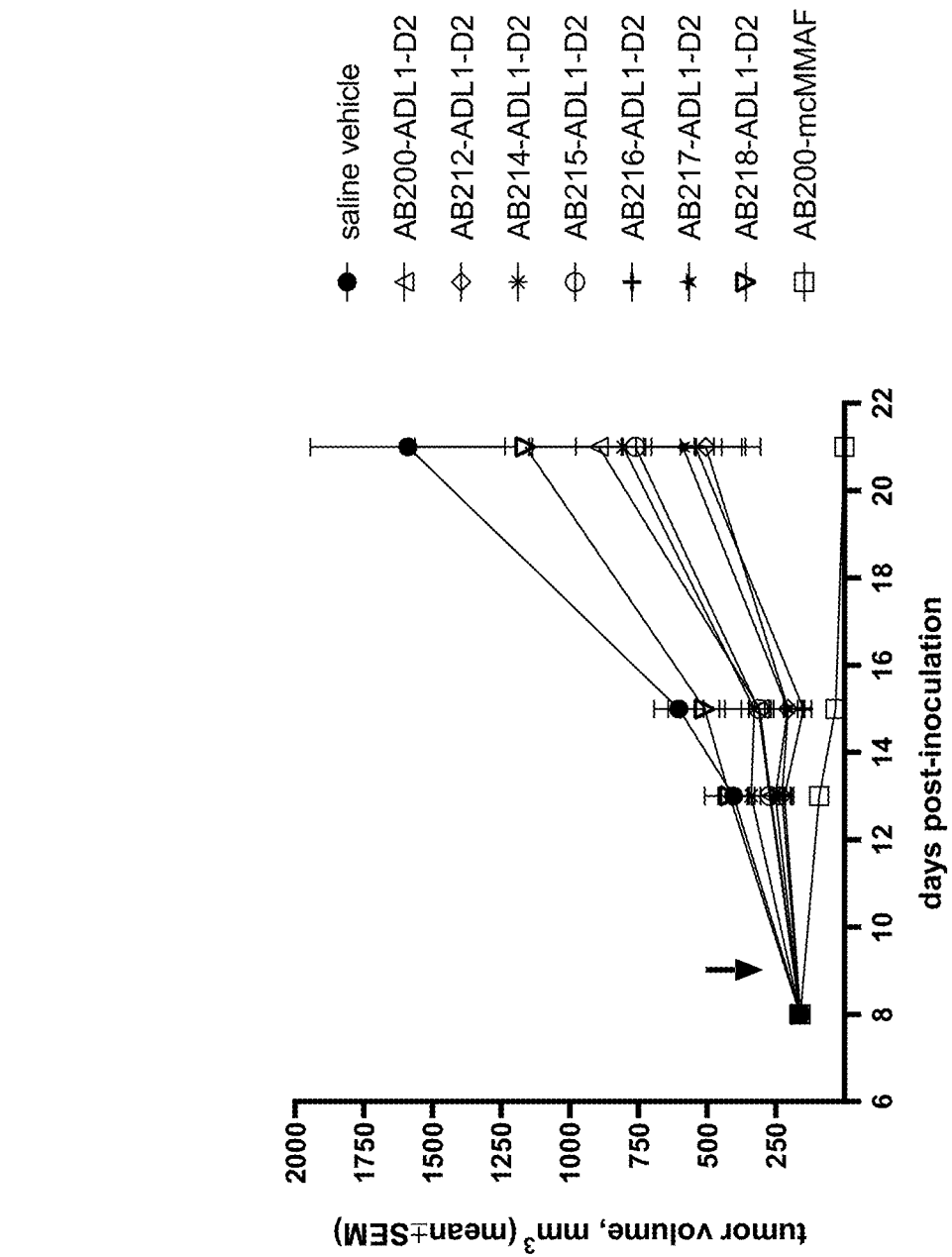
FIG. 15 shows in vivo anti-cancer activity of exemplary anti-BCMA ADCs in a MOLP8 xenograft model (study 1).

Methods: To further evaluate the anti-tumor activity of exemplary anti-BCMA ADCs in vivo, a screen of the same ADCs was performed in a second multiple myeloma xenograft model, MOLP8. The MOLP8 model was chosen for its lower cell surface BCMA expression levels relative to OPM2. All experimental conditions in this study were identical to those used for the OPM2 model with the exception of the model itself and the number of days from tumor inoculation to dose administration (day of dosing is indicated by an arrow in FIG. 15).

Results: All six tested ADCs incorporating anti-BCMA antibodies showed anti-tumor activity in the MOLP8 model (FIG. 15; Table 34), although the degree of response was reduced relative to results obtained in OPM2 xenografts (see OPM2 Studies 1 and 2 (FIG. 11 and FIG. 12; Tables 30 and 31)). All treatments, including the AB200-mcMMAF positive control, failed to meet statistical significance as determined by a mixed-effects model test.

TABLE 34

In vivo activity (MOLP8) - Study 1

| Treatment group | Drug-to-antibody ratio (DAR) | Tumor growth inhibition (% ± SEM, day 21) | Day 21 p-value (vs. saline vehicle)** |
|---|---|---|---|
| saline vehicle | NA | 0.0 | NA |
| AB200-ADL1-D2-05 | 4.07 (HIC) | 43.73 ± 5.22 | 0.6331 |
| AB212-ADL1-D2-02 | 5.17 (HIC) | 68.23 ± 12.52 | 0.2886 |
| AB214-ADL1-D2-02 | 4.12 (HIC) | 49.27 ± 20.79 | 0.7772 |
| AB215-ADL1-D2-02 | 3.96 (HIC) | 52.06 ± 24.38 | 0.7981 |
| AB216-ADL1-D2-02 | 3.8 (HIC) | 65.81 ± 11.49 | 0.3085 |
| AB217-ADL1-D2-02 | 3.7 (HIC) | 62.95 ± 8.99 | 0.3226 |
| AB218-ADL1-D2-02 | 3.77 (HIC) | 26.94 ± 25.37 | 0.9937 |
| AB200-mcMMAF-05 | 4.0 (HIC) | 100 ± 0 | 0.0653 |

**Mixed-effects model with Tukey's correction; NA, not applicable

Study 2

Methods: To further assess the anti-tumor activity of the AB212- and AB216-ADL1-D1 ADCs in vivo, each ADC was tested in the MOLP8 xenograft model by employing the same study design as used in the OPM2 xenograft model (see section 6.2 (Study 4)).

Figure 16:
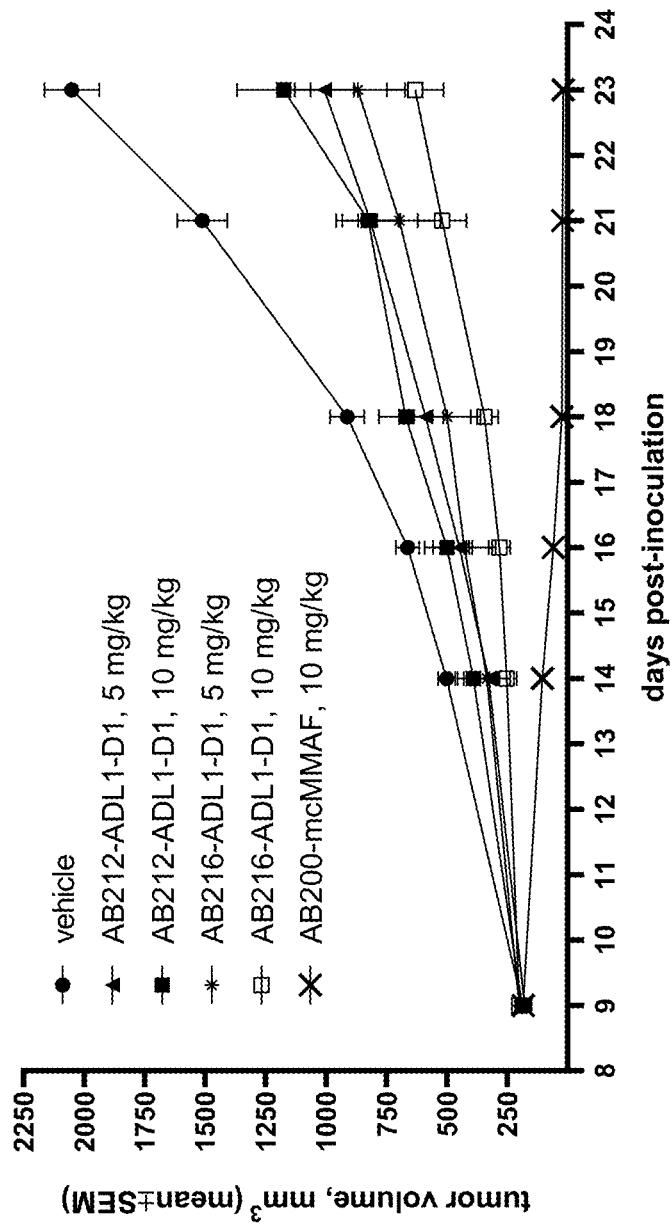
FIG. 16 shows in vivo anti-cancer activity of exemplary anti-BCMA ADCs in a MOLP8 xenograft model (study 2).
Figure 17B:
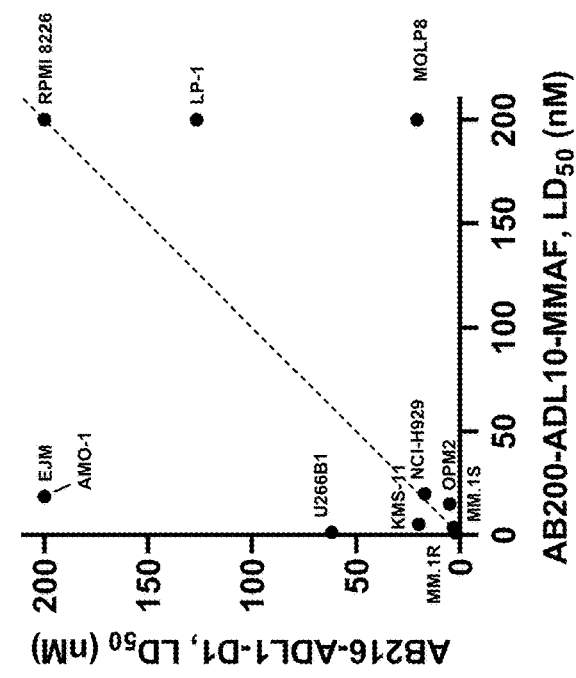
FIG. 17A-17D show in vitro cytotoxicity of AB216-ADL1-D1 (y-axis) and AB200-ADL10-MMAF (x-axis) on a panel of 11 human myeloma cell lines. Values for $GI_{50}$, $LD_{50}$, area under the curve (AUC) and maximum percent reduction in viable cells ($R_{min}$Ave) are shown in FIG. 17A-17D, respectively.
Figure 17A:
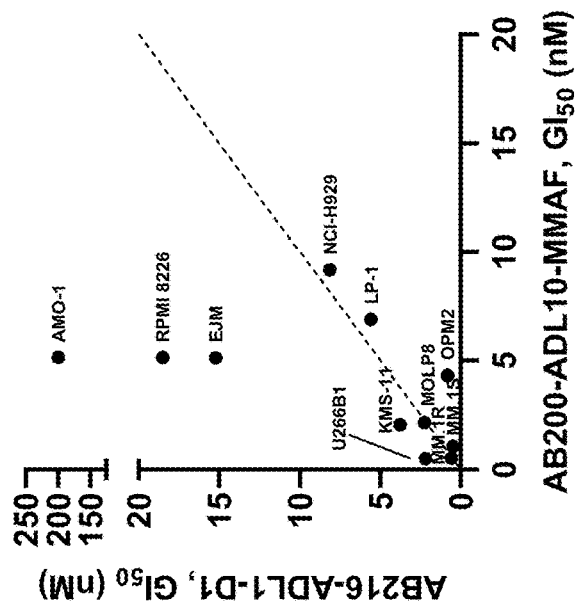
Figure 17D:
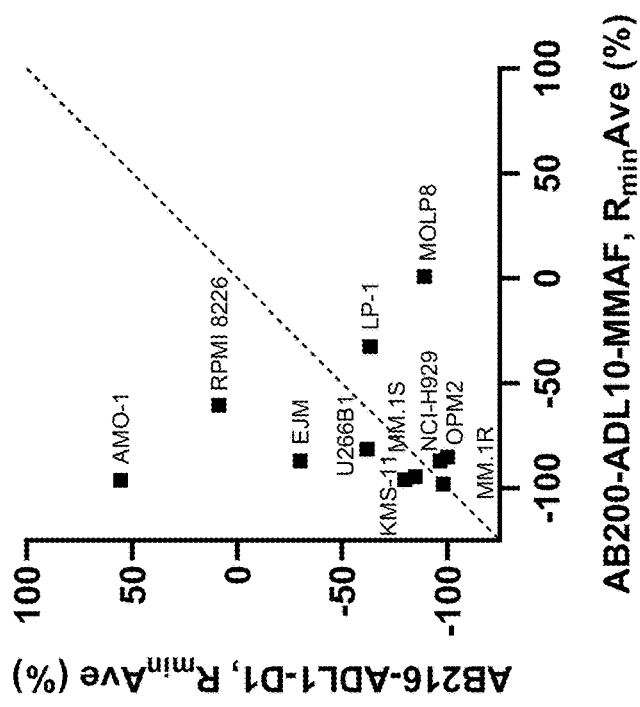
Figure 17C:
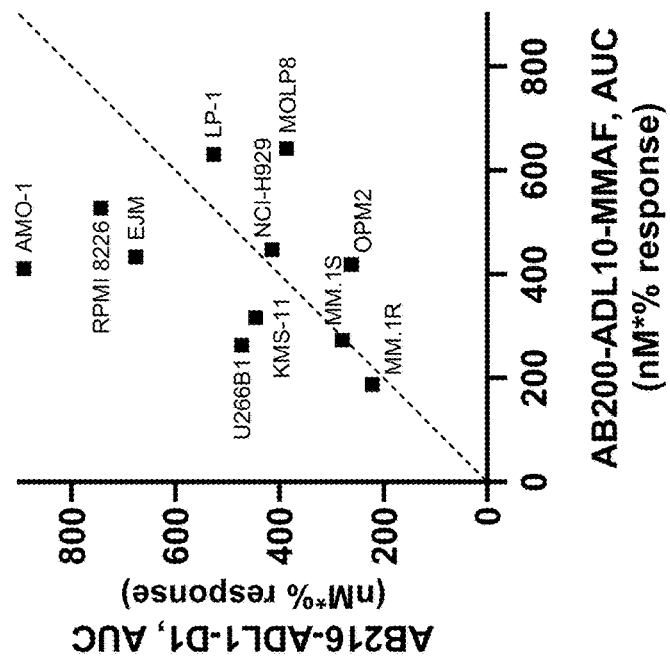

Results: In general, the degree of anti-tumor response for each ADC was less pronounced in MOLP8 tumors (FIG. 16; Table 35) than in OPM2 tumors (see OPM2 Study 4 (FIG. 14; Table 33)). However, consistent with data obtained in the OPM2 model, a single 10 mg/kg dose of AB216-ADL1-D1 induced greater tumor growth inhibition than the same dose of AB212-ADL1-D1 in MOLP8 tumors, although this difference did not meet statistical significance.

TABLE 35

In vivo activity (MOLP8) - Study 2

| Treatment group | Drug-to-antibody ratio (DAR) | Tumor growth inhibition (% ± SEM, day 23) | Day 23 p-value (vs. saline vehicle)** |
|---|---|---|---|
| saline vehicle | NA | 0.0 | NA |
| AB212-ADL1-D1-02, 10 mg/kg | 3.92 (HIC) | 42.72 ± 9.46 | 0.0154 |
| AB212-ADL1-D1-02, 5 mg/kg | 3.92 (HIC) | 50.95 ± 5.97 | <0.0001 |
| AB216-ADL1-D1-04, 10 mg/kg | 4.01 (HIC) | 69.24 ± 5.70 | <0.0001 |
| AB216-ADL1-D1-04, 5 mg/kg | 4.01 (HIC) | 57.65 ± 9.53 | 0.0013 |
| AB200-mcMMAF, 10 mg/kg | 4 (HIC) | 99.05 ± 0.51 | <0.0001 |

**Two-way ANOVA with Tukey's correction; NA, not applicable

Example 7

To evaluate the anti-proliferative activity and cytotoxicity of AB216-ADL1-D1 in vitro, cell viability assays were conducted on a panel of 11 human myeloma cell lines. AB200-ADL10-MMAF, a BCMA-targeting ADC with a monomethyl auristatin F (MMAF) payload, was used as a reference ADC.

7.1 Methods

All cells and ADC solutions were prepared in a laminar flow hood under sterile conditions. For each cell line to be assayed, cells were resuspended in the appropriate medium supplemented with FBS to a density of $5.56 \times 10^4$ cells/mL. 90 µL of cell suspension was added into all wells of clear-bottom, black-wall 96-well plates. For both AB216-ADL1-D1 and AB200-ADL10-MMAF, 10× stocks of the highest concentrations to be tested were prepared in 96-well plates and serially-diluted 1:3 eight times to generate a 9-point curve. 10 µL of each 10× test article solution was added to the appropriate wells of the 96-well plates containing 90 µL of cells, and plates were placed in humidified incubators at 37° C. with 5% $CO_2$ for 6 days. Immediately after placing assay plates in the incubator, a single 96-well plate of cells was treated with CellTiter-Glo® reagent (Promega), incubated at room temperature for 10 min, and luminescence was quantified on an EnVision microplate reader. This plate served as a "time zero" ($T_0$) reference and was used to interpret the data obtained after 6 days of incubation. Day-6 luminescence values less than those of the $T_0$ plate were indicative of cell death, whereas signals less than the day-6 vehicle-treated cells but greater than the $T_0$ signal were indicative of growth inhibition. No change in luminescence between $T_0$ and day-6 was indicative of cytostatic activity. Non-linear curve fitting was performed, and values for $GI_{50}$, $LD_{50}$, area under the curve (AUC) and maximum percent reduction in viable cells ($R_{min}$Ave) were calculated (FIG. 17A-17D, Table 36).

TABLE 36

Cell viability analysis of exemplary anti-BCMA ADCs and payloads

| Cell line | Sample* | GI$_{50}$ (nM) | LD$_{50}$ (nM) | AUC (nM * % relative viability) | R$_{min}$Ave (%) |
|---|---|---|---|---|---|
| AMO1 | AB200-ADL10-MMAF-08 | 5.1401 | 18.6701 | 410.4424 | −96.2963 |
| EJM | AB200-ADL10-MMAF-08 | 5.1252 | 18.526 | 433.4958 | −86.948 |
| KMS11 | AB200-ADL10-MMAF-08 | 2.0667 | 5.0785 | 316.1224 | −96.004 |
| LP1 | AB200-ADL10-MMAF-08 | 6.8874 | 200 | 631.2728 | −32.433 |
| MM1R | AB200-ADL10-MMAF-08 | 0.5176 | 1.0927 | 187.1393 | −98.0211 |
| MM1S | AB200-ADL10-MMAF-08 | 1.0687 | 3.5767 | 272.846 | −94.5485 |
| MOLP8 | AB200-ADL10-MMAF-08 | 2.1787 | 200 | 642.4165 | 0.7358 |
| NCIH929 | AB200-ADL10-MMAF-08 | 9.1772 | 19.9301 | 447.4034 | −87.0168 |
| OPM2 | AB200-ADL10-MMAF-08 | 4.3286 | 15.0413 | 419.0575 | −85.1705 |
| RPMI8226 | AB200-ADL10-MMAF-08 | 5.1339 | 200 | 527.8214 | −60.3736 |
| U266B1 | AB200-ADL10-MMAF-08 | 0.5138 | 1.3559 | 263.0274 | −81.3228 |
| AMO1 | AB216-ADL1-D1-11 | 200 | 200 | 891.1862 | 55.6686 |
| EJM | AB216-ADL1-D1-11 | 15.2131 | 200 | 677.1885 | −29.9836 |
| KMS11 | AB216-ADL1-D1-11 | 3.7797 | 19.8482 | 446.1838 | −79.5891 |
| LP1 | AB216-ADL1-D1-11 | 5.5985 | 126.5987 | 526.6666 | −63.2038 |
| MM1R | AB216-ADL1-D1-11 | 0.595 | 2.2385 | 222.669 | −97.8614 |
| MM1S | AB216-ADL1-D1-11 | 0.4871 | 3.161 | 278.454 | −84.5103 |
| MOLP8 | AB216-ADL1-D1-11 | 2.2557 | 20.7312 | 386.2652 | −88.9237 |
| NCIH929 | AB216-ADL1-D1-11 | 8.1696 | 16.9934 | 414.2477 | −96.3333 |
| OPM2 | AB216-ADL1-D1-11 | 0.8209 | 4.9075 | 262.267 | −99.9575 |
| RPMI8226 | AB216-ADL1-D1-11 | 18.5183 | 200 | 744.1032 | 8.7909 |
| U266B1 | AB216-ADL1-D1-11 | 2.1865 | 61.9232 | 472.5868 | −61.6649 |
| AMO1 | E7107 (D11) | 14.9441 | 50.4287 | 487.7156 | −96.8372 |
| EJM | E7107 (D11) | 9.4501 | 22.175 | 434.2294 | −99.071 |
| KMS11 | E7107 (D11) | 5.0303 | 13.1801 | 382.1527 | −99.2702 |
| LP1 | E7107 (D11) | 2.1964 | 6.2485 | 313.7701 | −99.6676 |
| MM1R | E7107 (D11) | 3.3314 | 16.5876 | 374.4113 | −99.831 |
| MM1S | E7107 (D11) | 3.5083 | 18.155 | 380.5913 | −99.7761 |
| MOLP8 | E7107 (D11) | 2.4266 | 16.8329 | 361.7797 | −99.6765 |
| NCIH929 | E7107 (D11) | 2.8056 | 5.836 | 321.415 | −99.8426 |
| OPM2 | E7107 (D11) | 1.6687 | 4.7541 | 289.9829 | −99.6884 |
| RPMI8226 | E7107 (D11) | 3.5859 | 10.8782 | 359.1272 | −99.7762 |
| U266B1 | E7107 (D11) | 8.7602 | 18.2733 | 422.0108 | −95.1886 |
| AMO1 | cisplatin | 8591.135 | 24857.88 | 984.2118 | −99.8648 |
| EJM | cisplatin | 30078.06 | 176520.2 | 994.2974 | −99.8757 |
| KMS11 | cisplatin | 14356.14 | 91414.66 | 985.6271 | −99.8489 |
| LP1 | cisplatin | 50066.58 | 624274.7 | 992.1409 | −97.8184 |
| MM1R | cisplatin | 7301.375 | 17616.3 | 980.905 | −99.9355 |
| MM1S | cisplatin | 10235 | 28357.22 | 988.9676 | −99.8687 |
| MOLP8 | cisplatin | 5074.514 | 71048.43 | 951.8638 | −99.8824 |
| NCIH929 | cisplatin | 21405.47 | 68415.23 | 996.5057 | −99.945 |
| OPM2 | cisplatin | 17006.21 | 74249.5 | 991.8044 | −99.784 |
| RPMI8226 | cisplatin | 16265.8 | 61944.01 | 992.6182 | −99.2206 |
| U266B1 | cisplatin | 39856.15 | 230392.8 | 996.024 | −99.4122 |
| AMO1 | MMAF | 100.7715 | 243.7059 | 640.894 | −99.5356 |
| EJM | MMAF | 51.4921 | 194.3761 | 600.0131 | −98.8551 |
| KMS11 | MMAF | 235.3249 | 490.3828 | 706.6578 | −98.8009 |
| LP1 | MMAF | 222.777 | 761.0403 | 724.5606 | −97.9742 |
| MM1R | MMAF | 281.0547 | 584.6173 | 721.5643 | −99.7818 |
| MM1S | MMAF | 296.01 | 615.7256 | 726.0671 | −99.8301 |
| MOLP8 | MMAF | 254.4448 | 4689.579 | 788.7538 | −58.9492 |
| NCIH929 | MMAF | 321.1 | 676.4428 | 734.8893 | −99.782 |
| OPM2 | MMAF | 348.0548 | 723.9832 | 740.134 | −99.7203 |
| RPMI8226 | MMAF | 224.3193 | 557.1533 | 714.2788 | −95.3537 |
| U266B1 | MMAF | 67.7634 | 192.3371 | 661.824 | −89.2656 |
| AMO1 | D1 | 566.6682 | 1689.735 | 797.7136 | −99.4709 |
| EJM | D1 | 140.2317 | 303.5191 | 664.163 | −99.0579 |
| KMS11 | D1 | 232.4131 | 485.9409 | 706.5255 | −99.3474 |
| LP1 | D1 | 112.0278 | 234.5168 | 643.9226 | −99.7195 |
| MM1R | D1 | 89.2849 | 283.0093 | 640.2408 | −99.9109 |
| MM1S | D1 | 88.3658 | 302.924 | 644.3501 | −99.8996 |
| MOLP8 | D1 | 149.5918 | 533.6503 | 690.1106 | −99.755 |
| NCIH929 | D1 | 118.567 | 246.6292 | 646.6007 | −99.8009 |
| OPM2 | D1 | 116.9262 | 256.8053 | 649.8734 | −99.7805 |
| RPMI8226 | D1 | 121.7242 | 253.1965 | 648.8833 | −99.6002 |
| U266B1 | D1 | 237.59 | 504.8119 | 712.6903 | −94.2191 |

*AB200-ADL10-MMAF-08 = batch 08 of AB200-ADL10-MMAF; AB216-ADL1-D1-11 = batch 11 of AB216-ADL1-D1.

7.2 Results

Pairwise comparison of the calculated potency metrics for AB216-ADL1-D1 versus the reference BCMA-targeting ADC (AB200-ADL10-MMAF) suggests that human myeloma cell lines may be sorted into three general classes, based on relative sensitivity to each ADC: more sensitive to AB216-ADL1-D1 than to AB200-ADL10-MMAF (AB216-ADL1-D1>AB200-ADL10-MMAF); similarly sensitive (e.g., potency values within a 2-fold range) to AB216-ADL1-D1 and AB200-ADL10-MMAF (AB216-ADL1-

D1≈AB200-ADL10-MMAF); and more sensitive to AB200-ADL10-MMAF than to AB216-ADL1-D1 (AB200-ADL10-MMAF>AB216-ADL1-D1). LP-1, NCI-H929, MOLP8, and OPM2 cells were more sensitive to AB216-ADL1-D1 than to AB200-ADL10-MMAF, with LP-1 and MOLP8 cells demonstrating the greatest difference in response between ADCs. Conversely, AMO-1, EJM, RPMI-8226, U266B1, and KMS-11 cells were more sensitive to AB200-ADL10-MMAF than to AB216-ADL1-D1, with AMO-1, EJM, and RPMI-8226 cells demonstrating the greatest difference in response between ADCs. MM1S and MM1R cells responded similarly to both ADCs, regardless of the potency metric used for comparison.

Example 8

The removal of introns from premature mRNAs both co-transcriptionally and post-transcriptionally via mRNA splicing is needed for the survival of all nucleated eukaryotic cell types, irrespective of proliferation state. To further evaluate the anti-proliferative activity of AB216-ADL1-D1, and to assess whether cell proliferation status may affect that activity, in vitro potency assays were conducted in actively-dividing myeloma cells and in the same cells grown under low-serum conditions to slow or arrest cell growth.

AB200-ADL10-MMAF, a BCMA-targeting ADC with a MMAF payload, was used as a reference ADC. It has been shown that auristatins such as MMAF exert their anti-proliferative effects by blocking tubulin polymerization and microtubule formation (Waight et al. (2016) PLoS One. 11(8):e0160890), which are required for several cellular processes including proper chromosomal segregation during mitosis (Petry (2016) Annu Rev Biochem. 85:659-683). Consistent with this mechanism of action, the activity of MMAF and other microtubule-disrupting agents is diminished in cells that are not actively undergoing cell division (Collins et al. (2019) Cancers. 11(3):394).

8.1 Methods

The human myeloma cell lines NCI-H929 (H929) and OPM2 were grown according to ATCC-recommended culture conditions (RPMI-1640 medium supplemented with 10% fetal bovine serum or 20% heat-inactivated fetal bovine serum, for H929 and OPM2 cells, respectively) in incubators maintained at 37° C. and 5% $CO_2$. To slow or arrest cell growth and generate cultures of non-dividing/slowly-dividing cells, cells grown under normal serum conditions were pelleted at 1200 rpm for 5 min, and the supernatant was aspirated. The cell pellet was washed three times by gently resuspending in room-temperature PBS followed by centrifugation at 1200 rpm for 5 min each time. Washed H929 and OPM2 cells were resuspended in RPMI-1640 medium containing 0.1% or 0.5% v/v fetal bovine serum, respectively (low-serum conditions) to a cell density of $5 \times 10^5$ cells/mL. Cell counts were performed daily to monitor cell growth. When the cultures had stopped growing (as determined by cell count), cells were harvested and plated in 96-well plates (5,000 cells/well) and subjected to ADC treatment as described above (see, e.g., Section 2.3).

8.2 Results

Figure 18:
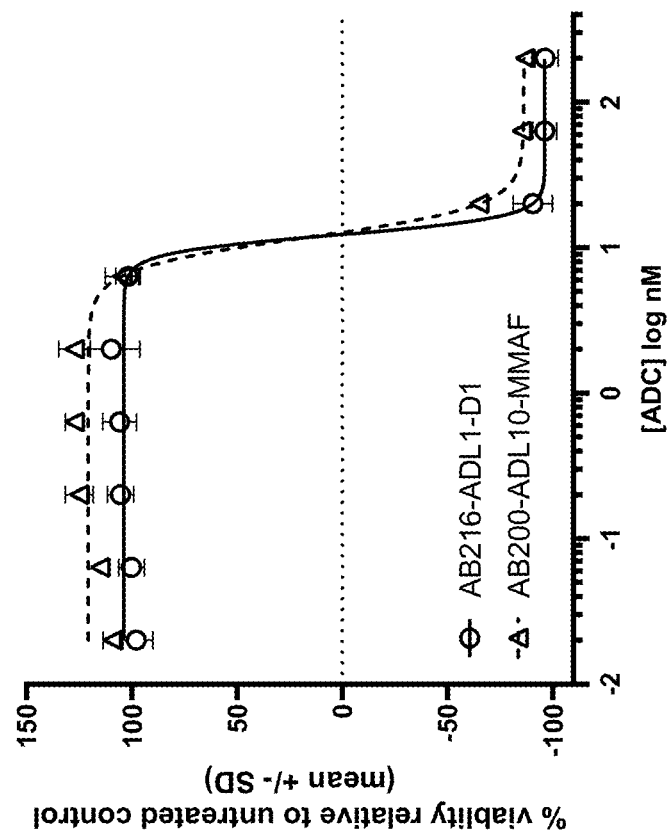
FIG. 18 shows an assessment of AB216-ADL1-D1 and AB200-ADL10-MMAF activity in a 6-day CellTiter-Glo® cell viability assay, under normal serum conditions, in NCI-H929 human myeloma cells.
Figure 19A:
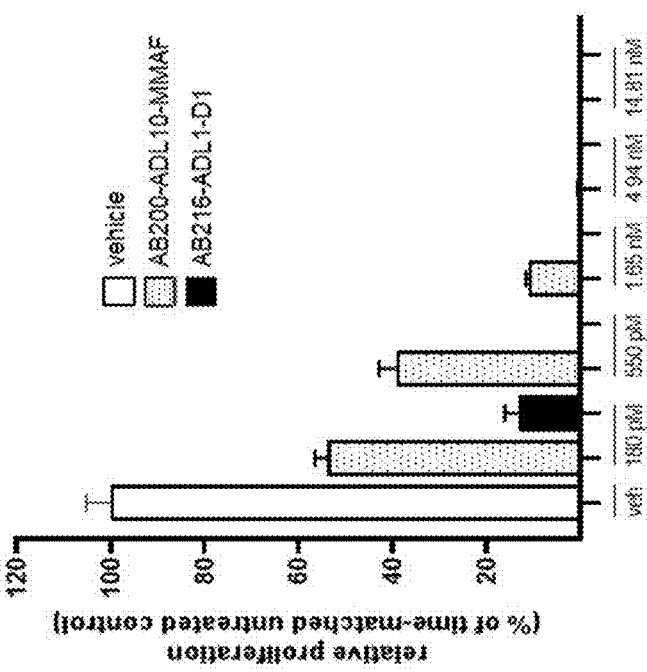
FIG. 19A-19B show biological repeats of a 6-day Cell-Titer-Glo® cell viability assessment of AB216-ADL1-D1 and AB200-ADL10-MMAF, under low serum conditions, in NCI-H929 human myeloma cells.
Figure 19B:
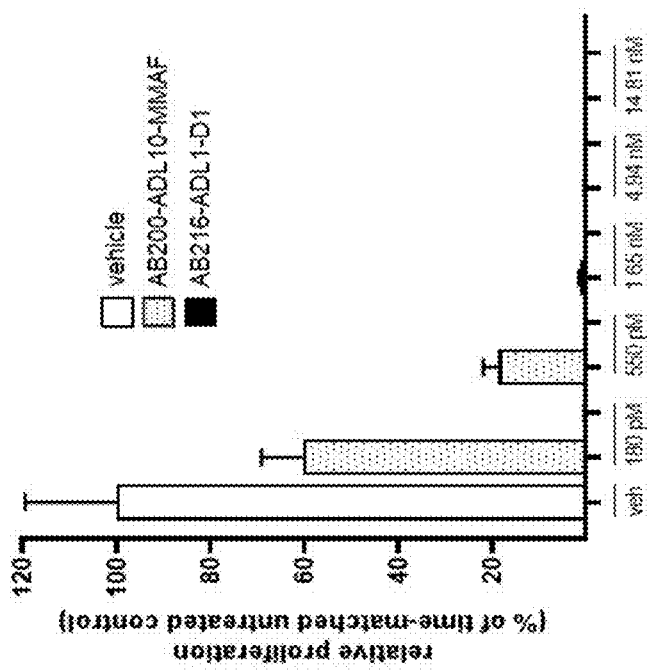

The anti-proliferative activities of AB216-ADL1-D1 and AB200-ADL10-MMAF were similar in exponentially-growing NCI-H929 cells cultured under normal serum conditions, with $GI_{50}$ and $LD_{50}$ values in the low nM range (FIG. 18). However, in NCI-H929 cells cultured in low-serum media to slow or halt proliferation, AB216-ADL1-D1 showed significantly greater activity than that of AB200-ADL10-MMAF. Over a range of concentrations below the $GI_{50}$ values for both ADCs, AB216-ADL1-D1 demonstrated increased anti-proliferative activity relative to AB200-ADL10-MMAF (FIG. 19A-19B). At the lowest ADC concentration shown (180 pM), AB216-ADL1-D1 treatment resulted in complete cell killing in a first experiment and an approximately 90% reduction in cell number in a replicate experiment. In contrast, 180 pM AB200-ADL10-MMAF treatment resulted in 40% and 45% reductions in cell number in the first and replicate experiments, respectively.

Figure 20:
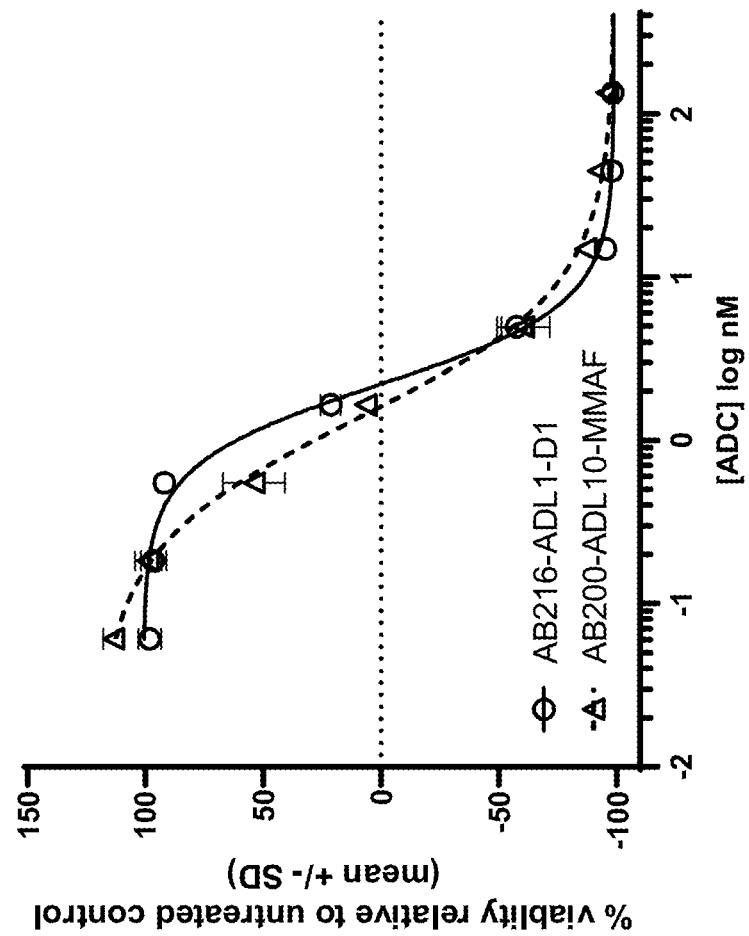
FIG. 20 shows an assessment of AB216-ADL1-D1 and AB200-ADL10-MMAF activity in a 6-day CellTiter-Glo® cell viability assay, under normal serum conditions, in OPM2 human myeloma cells.
Figure 21A:
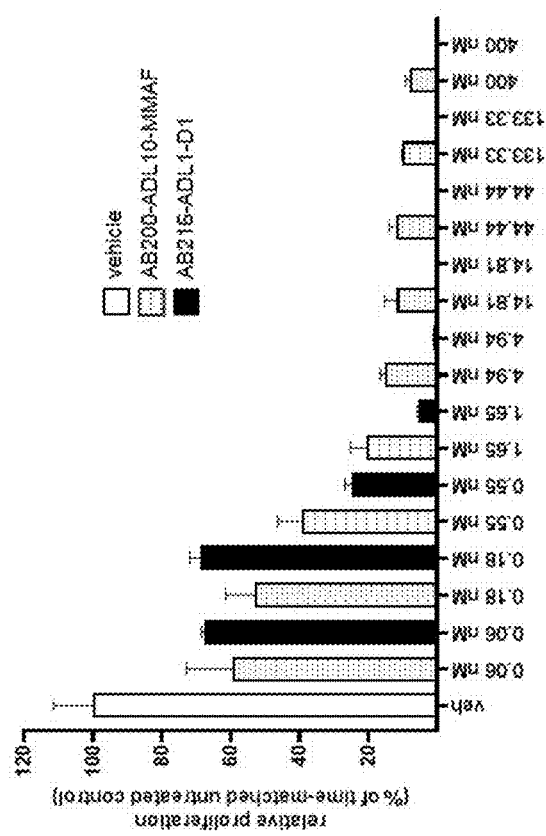
FIG. 21A-21B show biological repeats of a 6-day Cell-Titer-Glo® cell viability assessment of AB216-ADL1-D1 and AB200-ADL10-MMAF, under low serum conditions, in OPM2 human myeloma cells.
Figure 21B:
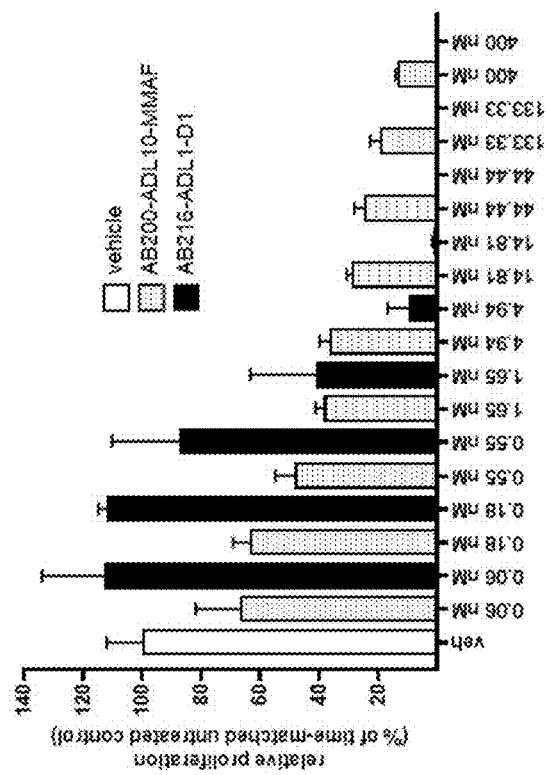

A second human myeloma cell line, OPM2, was tested and also shown to be similarly sensitive to AB216-ADL-D1 and AB200-ADL10-MMAF when cultured under normal serum conditions (FIG. 20). As with NCI-H929 cells, low-serum conditions were used to generate non-dividing/slowly-dividing OPM2 cultures and the OPM2 cells were subjected to the same 9-point dose response curves for AB216-ADL1-D1 and AB200-ADL10-MMAF. As observed in NCI-H929 cells, AB216-ADL1-D1 activity differed from that of AB200-ADL10-MMAF in non-proliferating cells (FIG. 21A-21B). However, in contrast to the trend observed in NCI-H929 cells, the anti-proliferative activity of AB216-ADL1-D1 was increased relative to that of AB200-ADL10-MMAF over the range of concentrations $\geq GI_{50}$ for both ADCs. AB200-ADL10-MMAF activity generally plateaued at concentrations above its approximate $GI_{50}$ value (~1.0 nM), whereas AB216-ADL1-D1 treatment over the same range of concentrations largely resulted in complete elimination of viable cells. These data suggest that AB216-ADL1-D1 may retain greater anti-proliferative activity than AB200-ADL10-MMAF in myeloma cells that are slowly-dividing or growth-arrested.

Example 9

To evaluate how overexpression of the MCL1-long isoform may affect the activity of AB216-ADL1-D1, and how AB216-ADL1-D1 treatment may affect the expression of endogenous MCL1 RNA and protein, in vitro modulation of MCL1 at the RNA and protein levels was assessed in NCI-H929 human myeloma cells following treatment with AB216-ADL1-D1. AB200-ADL10-MMAF was used as a reference ADC.

9.1 Methods

Generation of MCL1-overexpressing myeloma cell line: To investigate the effects of MCL1-long overexpression on the anti-proliferative activity of AB216-ADL1-D1 and AB200-ADL10-MMAF, an isogenic pair of RPMI-8226 human myeloma cell lines were lentivirally transduced with a pLVX expression cassette harboring either the human MCL1-long cDNA (RPMI-8226_MCL1) or no insert (RPMI-8226_EV). Constitutive MCL1 overexpression was confirmed in the RPMI-8226 MCL1 cells (data not shown). Both lines were subjected to a standard 6-day CTG assay as described above (see, e.g., Section 2.3).

In vitro modulation of MCL1 RNA and protein: To determine the ability of AB216-ADL1-D1 and AB200-ADL10-MMAF to negatively regulate expression of the pro-survival MCL1-long protein, the human myeloma cell line NCI-H929, which expresses high levels of MCL1 and is sensitive to both ADCs, was selected for evaluation. Approximately $10 \times 10^6$ NCI-H929 cells were seeded into T25 flasks at a density of $1.0 \times 10^6$ cells/mL in ATCC-recommended growth medium (RPMI-1640 supplemented with 10% v/v FBS and 50 µM 2-mercaptoethanol) and AB216-ADL1-D1 or AB200-ADL10-MMAF were added to final concentrations of 5.0, 50.0, or 500.0 nM. Duplicate flasks were prepared to allow for collection at 24 and 96 hours of treatment. Two additional flasks were prepared identically to the above and treated with normal saline solution (0.1% final concentration) to serve as a negative control at both time points. At 24 and 96 hours post-treatment, cells were transferred to 15 mL conical tubes and the flasks were rinsed with 3 mL of fresh cell culture medium to collect any remaining cells in the flask. This solution was added to the 15 mL conical tubes and the tubes were centrifuged at 2,000 rpm for 3 min to pellet the cells. The supernatant was aspirated off and the cells were rinsed by gentle resuspension of the pellet in 1.0 mL of ice-cold 1×PBS. Approximately one-third of each resuspended cell incubation with primary antibodies recognizing human MCL1 or vinculin (loading control) overnight at 4° C. The following day, membranes were washed three times with TBST to remove unbound antibody and incubated with anti-mouse or anti-rabbit secondary antibodies conjugated to horseradish peroxidase (HRP) for a minimum of 1 hour at room temperature. Following secondary antibody incubation, membranes were washed three times with TBST to remove unbound antibody. Membranes were then coated with an HRP substrate to generate a luminescent signal which was captured by CCD camera (ImageQuant, GE Healthcare).

TABLE 37

Summary - In vitro analysis

| RPMI-8226 cell line | Treatment group | Average $GI_{50}$ (nM) | | Average $LD_{50}$ (nM) | | Average $R_{min}$ (%) | |
|---|---|---|---|---|---|---|---|
| | | Experiment # | | | | | |
| | | 1 | 2 | 1 | 2 | 1 | 2 |
| Empty vector | AB216-ADL1-D1 | 13.1558 | 28.3342 | 107.2855 | 196.6309 | −98.6102 | −96.3514 |
| Empty vector | AB200-ADL10-MMAF | 2.2178 | 9.3246 | 52.6849 | 134.8997 | −90.7776 | −91.8757 |
| MCL1-L OE | AB216-ADL1-D1 | 69.3989 | 216.2403 | 266.6769 | >400 | −81.2685 | 31.5475 |
| MCL1-L OE | AB200-ADL10-MMAF | 15.398 | 81.6136 | >400 | >400 | −24.9337 | −34.6547 |

OE = overexpression.

pellet was transferred to a clean 1.7 mL microfuge tube and the remaining two-thirds was transferred to a second 1.7 mL microfuge tube. Microfuge tubes were centrifuged at 14,000 rpm for 10 min in a benchtop microcentrifuge precooled to 4° C. The PBS wash (supernatant) was aspirated off and each tube was briefly centrifuged once more to draw all liquid to the bottom. All remaining supernatant was aspirated off and each pellet was snap-frozen on dry ice and stored at −80° C. until isolation of RNA or protein.

Total RNA was prepared using the RNeasy kit (Qiagen) according to the manufacturer's instructions. RNA was eluted in 30 μL of elution buffer and quantified by UV spectrometry using a Nanodrop instrument. All RNAs were normalized to 25 ng/μL and 1.0 μg (40 μL) of each were converted to cDNA using the SuperScript IV VILO reverse transcription kit (ThermoFisher Scientific) according to the manufacturer's instructions. Gene expression changes were assessed by duplexed quantitative real-time PCR assay using a custom Taqman-style probe set targeting the human MCL1-long isoform (amplicon spans the exon 2-3 junction) and a commercially-available 18S rRNA probe set (internal normalization control). Raw data were analyzed using the ΔΔCt method and normalized to the signal for the 24-hour untreated sample.

Protein lysates were prepared by lysing cell pellets in RIPA buffer followed by brief sonication at low power to shear genomic DNA. Lysates were centrifuged for 10 min at 14,000 rpm in a benchtop microcentrifuge precooled to 4° C. and the soluble protein fraction was transferred to a fresh 1.7 mL microfuge tube. Lysates were quantified by BCA assay and normalized with RIPA buffer and 4×SDS loading dye supplemented with 1.0% 2-mercaptoethanol. Normalized lysates were briefly vortexed and heated to 95° C. for 10 min to fully denature the sample. Approximately 10 μg of total protein/lane was loaded on 4-12% Bis-Tris acrylamide gradient gels (LifeTech) and proteins were resolved by electrophoresis. Proteins were transferred to nitrocellulose membranes which were blocked with 5% BSA or 5% non-fat dry milk for a minimum of 30 min at room temperature before 9.2 Results The results of two independent experiments using the isogenic pair of RPMI-8226 cell lines demonstrated that constitutive MCL1L overexpression partially rescues the anti-proliferative effects of AB216-ADL1-D1 and the reference ADC, AB200-ADL10-MMAF, in a 6-day cell viability assay. This is consistent with the anti-apoptotic role of MCL1L, whose expression can abrogate the effects of and promote resistance to a range of therapeutics with broadly varying mechanisms of action (Song et al. (2005) Cancer Biol Ther. 4(3):267-276; Pei et al. (2014) PLoS One. 9(3): e89064; Wuillème-Toumi et al. (2005) Leukemia. 19(7): 1248-1252). Calculated $GI_{50}$, $LD_{50}$, and maximum effect level ($R_{min}$ %) values are summarized in Table 37.

Figure 22:
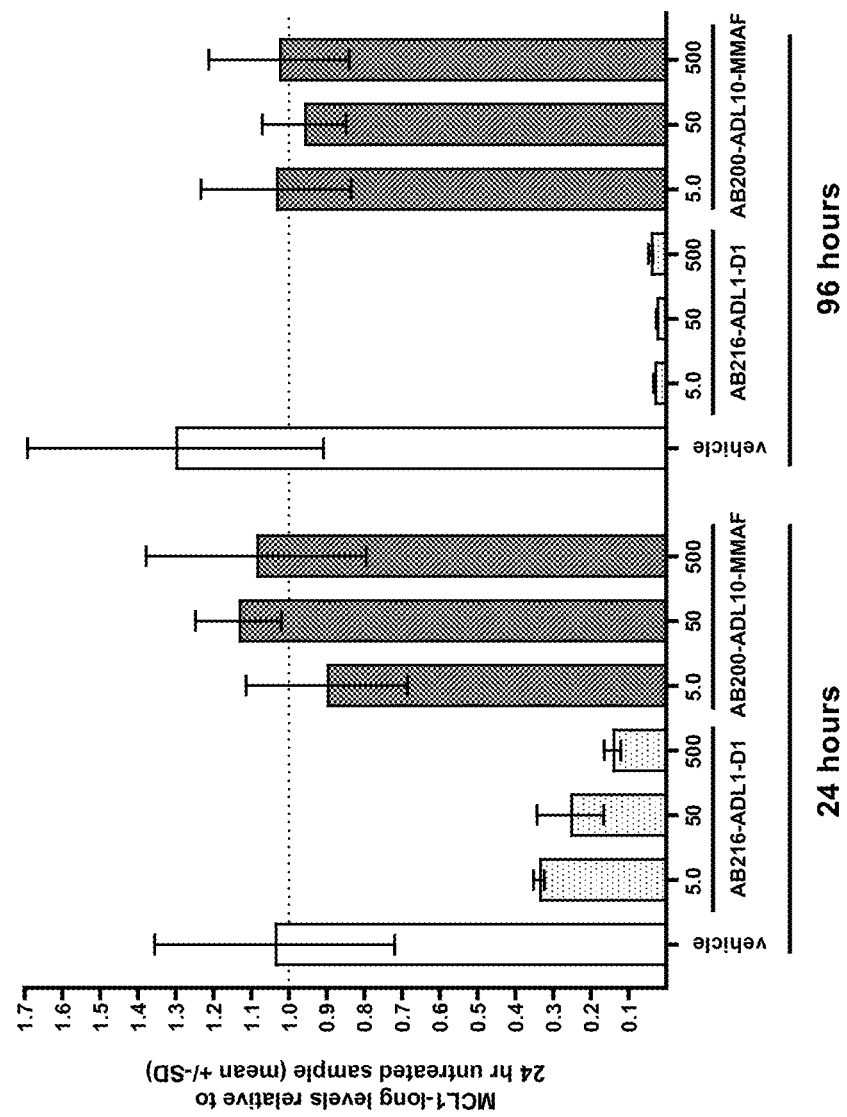
FIG. 22 shows mRNA levels of the long, pro-survival isoform of MCL1 (MCL1L) in NCI-H929 human myeloma cells treated with AB216-ADL1-D1 or AB200-ADL10-MMAF at 5, 50, or 500 nM for 24 or 96 hours.

Given the role of MCL1L in promoting plasma cell survival and resistance to several standard-of-care myeloma therapies, the ability of AB216-ADL1-D1 and AB200-ADL10-MMAF to suppress MCL1L expression at the RNA and protein levels was evaluated. Using the NCI-H929 cell line, MCL1L mRNA levels were quantified in cells treated with AB216-ADL1-D1 or AB200-ADL10-MMAF at 5, 50, or 500 nM for 24 or 96 hours. After 24 hours of treatment, a concentration-dependent decrease in MCL1L RNA in cells treated with AB216-ADL1-D1 was observed, with a maximum suppression of approximately 85% at the highest concentration (500 nM). In contrast, MCL1 RNA levels in AB200-ADL10-MMAF-treated cells were not significantly altered at any concentration after 24 hours (FIG. 22). MCL1L RNA levels were further reduced by AB216-ADL1-D1 after 96 hours of treatment, with maximum suppression of >95% even at the lowest concentration of 5 nM. Lastly, consistent with observations after 24 hours of treatment, AB200-ADL10-MMAF did not affect MCL1L RNA expression at 96 hours at any concentration. The term "vehicle" in FIG. 22 refers to cells treated with 0.1% v/v normal saline solution as a negative control for MCL1L modulation, which served as a benchmark for MCL1L mRNA levels at both time points. Data shown were calculated relative to the 24 hour vehicle sample.

Figure 23:
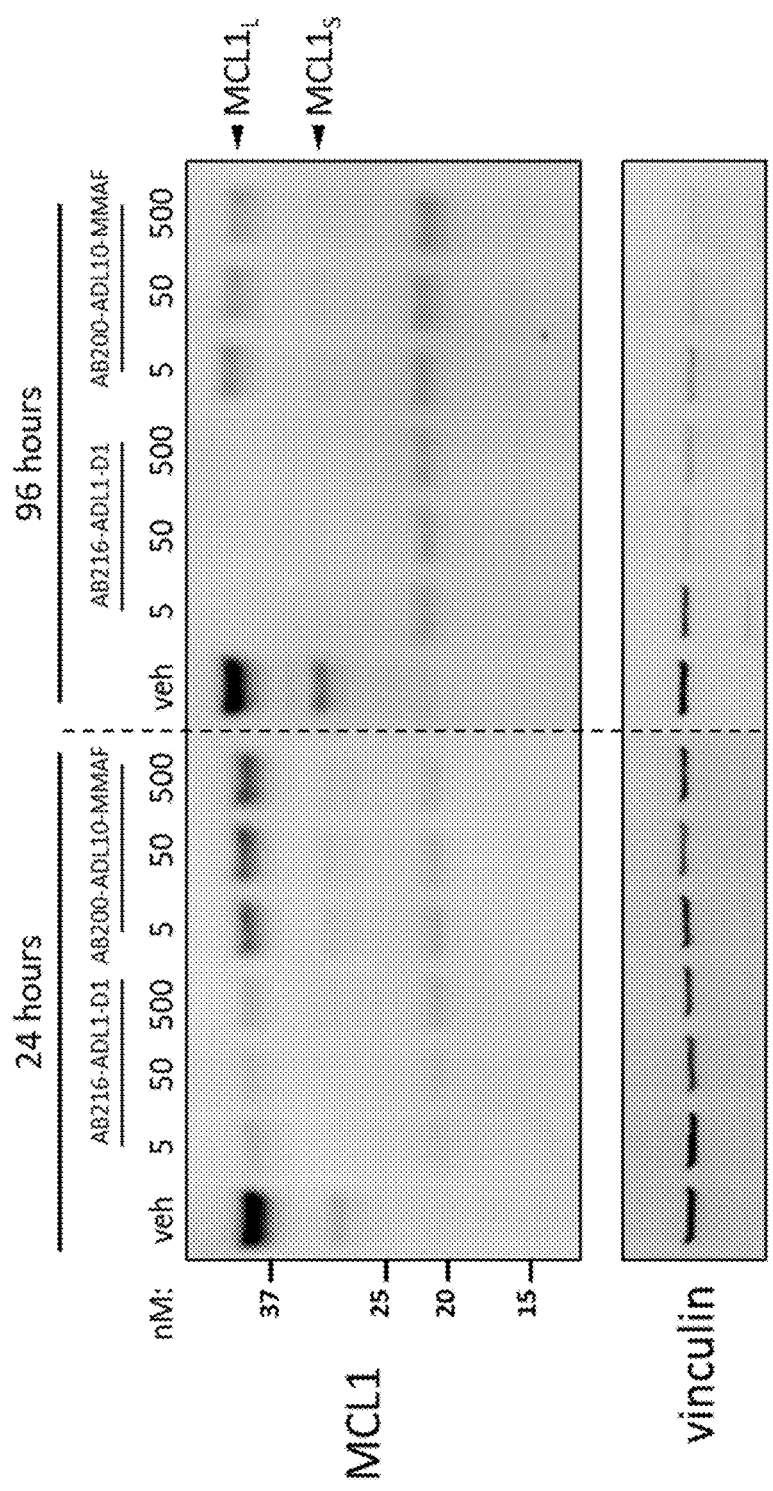
FIG. 23 shows an immunoblot analysis of MCL1 expression in NCI-H929 human myeloma cells treated with AB216-ADL1-D1 or AB200-ADL10-MMAF at 5, 50, or 500 nM for 24 or 96 hours.

An immunoblot analysis of MCL1 was also conducted with an antibody recognizing an epitope near leucine 210, which produced bands at sizes consistent with MCL1L (~42 kDa) and MCL1S (~32 kDa), as well as additional bands of varying size and intensities (FIG. 23). Vinculin was used as a loading control. The term "vehicle" (or "veh") in FIG. 23 refers to cells treated with 0.1% v/v normal saline solution as a negative control for MCL1L modulation, which served as a benchmark for MCL1L protein levels at both time points.

Consistent with the RNA-level data, AB216-ADL1-D1 treatment strongly downregulated MCL1L protein levels after 24 hours, and MCL1L was nearly undetectable in AB216-ADL1-D1-treated lysates after 96 hours. Conversely, MCL1L protein was modestly suppressed by AB200-ADL10-MMAF at 24 hours and was further suppressed at 96 hours but remained detectable (FIG. 23). The apparent difference between AB200-ADL10-MMAF-induced MCL1 modulation at the RNA and protein levels may result from post-translational mechanisms such as caspase-mediated cleavage, which has been described for MCL1L (Michels et al. (2004) Oncogene. 23(28):4818-4827). Taken together, these data demonstrate the unique ability of AB216-ADL1-D1 to potently downregulate MCL1L RNA and protein expression. This is in contrast to the AB200-ADL10-MMAF reference ADC, which did not modulate MCL1L RNA levels and only modestly affected MCL1L protein levels in NCI-H929 cells.

TABLE 38

Light Chain Screening (Round 1): Fab fragment sequences

| Heavy chain (Fab) amino acid sequence paired with listed light chain clones (AB200_D99H) | QVQLVQSGAEVKKPGSSVKVSCKASGGTFSNYWMHWVRQAPGQGLEWMGATYRGHSDTYYNQKFKGRVTITADKSTSTAYMELSSLRS EDTAVYYCARGAIYHGYDVLDNWGQGTLVTVSSASTKGPSVFPLAPSSKSTSGGTAALGCLVKDYFPEPVTVSWNSGALTSGVHTFPAVLQ SSGLYSLSSVVTVPSSSLGTQTYICNVNHKPSNTKVDKKVEPKSC (SEQ ID NO: 134) |
|---|---|

| Clone ID | Light chain (Fab) amino acid sequence | K$_d$ hsBCMA (nM) | K$_d$ RhBCMA (nM) | T$_m$ (° C.) |
|---|---|---|---|---|
| AB200-R1a-Fab_Vk1 | DIQMTQSPSSLSASVGDRVTITCRASQDISSYLNWYQQKPGKAPKLLIYYTSNIHSGVPSRFSGS GSGTDFTLTISSLQPEDFATYYCQQYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 135) | 1.751 | 6.369 | 82.67 |
| AB200-R1a-Fab_Vk2 | DIQMTQSPSSLSASVGDRVTITCSASQEVSNYLNWYQQKPGKAPKLLIYYTSNLHSGVPSRFSG SGSGTDFTLTISSLQPEDFATYYCQEYRKLPWTFGQGTKLEIKRTVAAPSVFIFPPSDEQLKSGT ASVVCLLNNFYPREAKVQWKVDNALQSGNSQESVTEQDSKDSTYSLSSTLTLSKADYEKHKVY ACEVTHQGLSSPVTKSFNRGEC (SEQ ID NO: 136) | 4.267 | 14.891 | 75.43 |
| AB200-R1a-Fab_Vk3 | DIQMTQSPSSLSASVGDRVTITCSASQDISNYINWYQQKPGKAPKLLIYYTSNMHSGVPSRFSGS GSGTDFTLTISSLQPEDFATYYCQQYRKLPWSFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 137) | 1.844 | 6.211 | 80.00 |
| AB200-R1a-Fab_Vk4 | DIQMTQSPSSLSASVGDRVTITCTATQDITNYLNWYQQKPGKAPKLLIYYTSNLHSGVPSRFSGS GSGTDFTLTISSLQPEDFATYYCQQYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 138) | 2.199 | 7.902 | 82.26 |
| AB200-R1a-Fab_Vk5 | DIQMTQSPSSLSASVGDRVTITCSASQDISSYLNWYQQKPGKAPKLLIYYTSNLHSGVPSRFSGS GSGTDFTLTISSLQPEDFATYYCQQYRSTPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 139) | 7.832 | 27.521 | 81.10 |
| AB200-R1a-Fab_Vk6 | DIQMTQSPSSLSASVGDRVTITCSATQDISNYLNWYQQKPGKAPKLLIYFTSNLQSGVPSRFSGS GSGTDFTLTISSLQPEDFATYYCQQYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 140) | 1.110 | 4.261 | 81.31 |
| AB200-R1a-Fab_Vk7 | DIQMTQSPSSLSASVGDRVTITCSASQDISNFLNWYQQKPGKAPKLLIYYTSNLHSGVPSRFSGS GSGTDFTLTISSLQPEDFATYYCQQFRKMPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 141) | 14.659 | 25.080 | 84.48 |
| AB200-R1a-Fab_Vk8 | DIQMTQSPSSLSASVGDRVTITCSASQDISNYLNWYQQKPGKAPKLLIYYTSNLQSGVPSRFSG SGSGTDFTLTISSLQPEDFATYYCHQSRKLPWTFGQGTKLEIKRTVAAPSVFIFPPSDEQLKSGT ASVVCLLNNFYPREAKVQWKVDNALQSGNSQESVTEQDSKDSTYSLSSTLTLSKADYEKHKVY ACEVTHQGLSSPVTKSFNRGEC (SEQ ID NO: 142) | 24.070 | 42.092 | 83.90 |
| AB200-R1a-Fab_Vk9 | DIQMTQSPSSLSASVGDRVTITCSASQEISNYLNWYQQKPGKAPKLLIYATSNLHSGVPSRFSGS GSGTDFTLTISSLQPEDFATYYCQQYRKLPWSFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 143) | 2.044 | 8.034 | 84.44 |

TABLE 38-continued

Light Chain Screening (Round 1): Fab fragment sequences

| | | | | |
|---|---|---|---|---|
| AB200-R1a-Fab_Vk10 | DIQMTQSPSSLSASVGDRVTITCSASQSISNYLNWYQQKPGKAPKLLIYYTSNLHSGVPSRFSGS GSGTDFTLTISSLQPEDFATYYCQQSRKMPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 144) | 109.981 | 194.645 | 86.11 |
| AB200-R1a-Fab_Vk11 | DIQMTQSPSSLSASVGDRVTITCRASQDVSNYLNWYQQKPGKAPKLLIYYTTNLHSGVPSRFSG SGSGTDFTLTISSLQPEDFATYYCQQYRKLPWTFGQGTKLEIKRTVAAPSVFIFPPSDEQLKSGT ASVVCLLNNFYPREAKVQWKVDNALQSGNSQESVTEQDSKDSTYSLSSTLTLSKADYEKHKVY ACEVTHQGLSSPVTKSFNRGEC (SEQ ID NO: 145) | 1.530 | 5.740 | 83.58 |
| AB200-R1a-Fab_Vk12 | DIQMTQSPSSLSASVGDRVTITCSASQDISNYLNWYQQKPGKAPKLLIYYATNLHSGVPSRFSGS GSGTDFTLTISSLQPEDFATYYCQQYRRLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 146) | 4.894 | 16.819 | 83.23 |
| AB200-R1a-Fab_Vk13 | DIQMTQSPSSLSASVGDRVTITCSASNDISNYLNWYQQKPGKAPKLLIYYSSDLHSGVPSRFSGS GSGTDFTLTISSLQPEDFATYYCQQYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 147) | 7.144 | 24.571 | 79.40 |
| AB200-R1a-Fab_Vk14 | DIQMTQSPSSLSASVGDRVTITCSASQDISNYLNWYQQKPGKAPKLLIYYSSNMHSGVPSRFSG SGSGTDFTLTISSLQPEDFATYYCQQFRKLPWTFGQGTKLEIKRTVAAPSVFIFPPSDEQLKSGT ASVVCLLNNFYPREAKVQWKVDNALQSGNSQESVTEQDSKDSTYSLSSTLTLSKADYEKHKVY ACEVTHQGLSSPVTKSFNRGEC (SEQ ID NO: 148) | 4.029 | 11.504 | 82.31 |
| AB200-R1a-Fab_Vk15 | DIQMTQSPSSLSASVGDRVTITCSASHEISNYLNWYQQKPGKAPKLLIYYTSSLHSGVPSRFSGS GSGTDFTLTISSLQPEDFATYYCQQYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 149) | 2.926 | 9.710 | 81.31 |
| AB200-R1a-Fab_Vk16 | DIQMTQSPSSLSASVGDRVTITCSASQDITNYLNWYQQKPGKAPKLLIYATSNLHSGVPSRFSGS GSGTDFTLTISSLQPEDFATYYCQEYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 150) | 3.179 | 12.899 | 80.67 |
| AB200-R1a-Fab_Vk17 | DIQMTQSPSSLSASVGDRVTITCATQDISNYLNWYQQKPGKAPKLLIYYTTNLHSGVPSRFSGS GSGTDFTLTISSLQPEDFATYYCQQYYKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 151) | 4.450 | 7.714 | 83.11 |
| AB200-R1a-Fab_Vk18 | DIQMTQSPSSLSASVGDRVTITCTASQDISNYLNWYQQKPGKAPKLLIYYTSDLHIGVPSRFSGS GSGTDFTLTISSLQPEDFATYYCQQYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 152) | 2.934 | 10.971 | 81.44 |
| AB200-R1a-Fab_Vk19 | DIQMTQSPSSLSASVGDRVTITCSASNDISNYINWYQQKPGKAPKLLIYYTSNLHSGVPSRFSGS GSGTDFTLTISSLQPEDFATYYCQQYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 153) | 2.068 | 5.740 | 83.86 |
| AB200-R1a-Fab_Vk20 | DIQMTQSPSSLSASVGDRVTITCSASQDISNFLNWYQQKPGKAPKLLIYYTSDLHSGVPSRFSGS GSGTDFTLTISSLQPEDFATYYCQQYYKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 154) | 12.837 | 13.521 | 82.03 |
| AB200-R1a-Fab_Vk21 | DIQMTQSPSSLSASVGDRVTITCSASQDISNYLNWYQQKPGKAPKLLIYYTSNLHSGVPSRFSGS GSGTDFTLTISSLQPEDFATYYCHQYKKTPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 155) | 32.682 | 61.435 | 80.80 |
| AB200-R1a-Fab_Vk22 | DIQMTQSPSSLSASVGDRVTITCRASQDISNYLNWYQQKPGKAPKLLIYYTSNLHSGVPSRFSG SGSGTDFTLTISSLQPEDFATYYCQQYRSIPWTFGQGTKLEIKRTVAAPSVFIFPPSDEQLKSGT ASVVCLLNNFYPREAKVQWKVDNALQSGNSQESVTEQDSKDSTYSLSSTLTLSKADYEKHKVY ACEVTHQGLSSPVTKSFNRGEC (SEQ ID NO: 156) | 2.481 | 9.914 | 84.15 |
| AB200-R1a-Fab_Vk23 | DIQMTQSPSSLSASVGDRVTITCSASQDISNYLNWYQQKPGKAPKLLIYYTSNIHSGVPSRFSGS GSGTDFTLTISSLQPEDFATYYCQQYKKMPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 157) | 16.764 | 29.693 | 83.32 |
| AB200-R1a-Fab_Vk24 | DIQMTQSPSSLSASVGDRVTITCSASNSISNYLNWYQQKPGKAPKLLIYYASNLHSGVPSRFSGS GSGTDFTLTISSLQPEDFATYYCQQYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 158) | 5.113 | 14.180 | 81.41 |

TABLE 38-continued

Light Chain Screening (Round 1): Fab fragment sequences

| | | | | |
|---|---|---|---|---|
| AB200-R1a-Fab_Vk25 | DIQMTQSPSSLSASVGDRVTITCSASQDISNYLNWYQQKPGKAPKLLIYAASNLHSGVPSRFSG SGSGTDFTLTISSLQPEDFATYYCQQYRKIPWTFGQGTKLEIKRTVAAPSVFIFPPSDEQLKSGT ASVVCLLNNFYPREAKVQWKVDNALQSGNSQESVTEQDSKDSTYSLSSTLTLSKADYEKHKVY ACEVTHQGLSSPVTKSFNRGEC (SEQ ID NO: 159) | 3.437 | 13.635 | 85.93 |
| AB200-R1a-Fab_Vk26 | DIQMTQSPSSLSASVGDRVTITCSASQDISNYLNWYQQKPGKAPKLLIYYSSSLHIGVPSRFSGS GSGTDFTLTISSLQPEDFATYYCQQYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 160) | 5.557 | 17.858 | 82.42 |
| AB200-R1a-Fab_Vk27 | DIQMTQSPSSLSASVGDRVTITCSASQDITNYLNWYQQKPGKAPKLLIYFTSNLHSGVPSRFSGS GSGTDFTLTISSLQPEDFATYYCQQYYKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 161) | 6.388 | 10.655 | 82.86 |
| AB200-R1a-Fab_Vk28 | DIQMTQSPSSLSASVGDRVTITCSASQDISNFLNWYQQKPGKAPKLLIYYTSNMHSGVPSRFSG SGSGTDFTLTISSLQPEDFATYYCQQYRSLPWTFGQGTKLEIKRTVAAPSVFIFPPSDEQLKSGT ASVVCLLNNFYPREAKVQWKVDNALQSGNSQESVTEQDSKDSTYSLSSTLTLSKADYEKHKVY ACEVTHQGLSSPVTKSFNRGEC (SEQ ID NO: 162) | 4.870 | 7.573 | 81.80 |
| AB200-R1a-Fab_Vk29 | DIQMTQSPSSLSASVGDRVTITCSASHDVSNYLNWYQQKPGKAPKLLIYYTSNLHSGVPSRFSG SGSGTDFTLTISSLQPEDFATYYCQQYRRLPWTFGQGTKLEIKRTVAAPSVFIFPPSDEQLKSGT ASVVCLLNNFYPREAKVQWKVDNALQSGNSQESVTEQDSKDSTYSLSSTLTLSKADYEKHKVY ACEVTHQGLSSPVTKSFNRGEC (SEQ ID NO: 163) | 1.547 | 4.963 | 82.79 |
| AB200-R1a-Fab_Vk30 | DIQMTQSPSSLSASVGDRVTITCTASQSISNYINWYQQKPGKAPKLLIYYTSNLHSGVPSRFSGS GSGTDFTLTISSLQPEDFATYYCQQYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 164) | 1.562 | 4.777 | 82.50 |
| AB200-R1a-Fab_Vk31 | DIQMTQSPSSLSASVGDRVTITCSASQDISNYLNWYQQKPGKAPKLLIYYTSNIHIGVPSRFSGS GSGTDFTLTISSLQPEDFATYYCQQYRKLPWSFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 165) | 2.361 | 8.960 | 81.68 |
| AB200-R1a-Fab_Vk32 | DIQMTQSPSSLSASVGDRVTITCSASQDLSNYLNWYQQKPGKAPKLLIYYTSSLHSGVPSRFSG SGSGTDFTLTISSLQPEDFATYYCQQYRKTPWTFGQGTKLEIKRTVAAPSVFIFPPSDEQLKSGT ASVVCLLNNFYPREAKVQWKVDNALQSGNSQESVTEQDSKDSTYSLSSTLTLSKADYEKHKVY ACEVTHQGLSSPVTKSFNRGEC (SEQ ID NO: 166) | 11.730 | 44.701 | 79.68 |
| AB200-R1a-Fab_Vk33 | DIQMTQSPSSLSASVGDRVTITCSASQDISSYLNWYQQKPGKAPKLLIYFTSNLHSGVPSRFSGS GSGTDFTLTISSLQPEDFATYYCQQSRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 167) | 19.479 | 37.407 | 85.36 |
| AB200-R1a-Fab_Vk34 | DIQMTQSPSSLSASVGDRVTITCSASHDISNYLNWYQQKPGKAPKLLIYYTSNLHSGVPSRFSGS GSGTDFTLTISSLQPEDFATYYCQQYCHEYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 168) | 26.490 | 74.744 | 76.90 |
| AB200-R1a-Fab_Vk35 | DIQMTQSPSSLSASVGDRVTITCSASQDLSNYLNWYQQKPGKAPKLLIYYTSNLHSGVPSRFSG SGSGTDFTLTISSLQPEDFATYYCQQYKKIPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 169) | 7.297 | 18.913 | 82.69 |
| AB200-R1a-Fab_Vk36 | DIQMTQSPSSLSASVGDRVTITCSASQDLSNYLNWYQQKPGKAPKLLIYYTSNLQSGVPSRFSG SGSGTDFTLTISSLQPEDFATYYCQQYRRLPWTFGQGTKLEIKRTVAAPSVFIFPPSDEQLKSGT ASVVCLLNNFYPREAKVQWKVDNALQSGNSQESVTEQDSKDSTYSLSSTLTLSKADYEKHKVY ACEVTHQGLSSPVTKSFNRGEC (SEQ ID NO: 170) | 1.431 | 5.056 | 81.26 |
| AB200-R1a-Fab(hCDR1) | DIQMTQSPSSLSASVGDRVTITCRASQSISSYLNWYQQKPGKAPKLLIYYTSNLHSGVPSRFSGS GSGTDFTLTISSLQPEDFATYYCQQYRKLPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 171) | 1.580 | 5.305 | 82.81 |
| AB200-R1a-Fab(hCDR2) | DIQMTQSPSSLSASVGDRVTITCSASQDISNYLNWYQQKPGKAPKLLIYAASSLQSGVPSRFSG SGSGTDFTLTISSLQPEDFATYYCQQYRKLPWTFGQGTKLEIKRTVAAPSVFIFPPSDEQLKSGT ASVVCLLNNFYPREAKVQWKVDNALQSGNSQESVTEQDSKDSTYSLSSTLTLSKADYEKHKVY ACEVTHQGLSSPVTKSFNRGEC (SEQ ID NO: 172) | 2.143 | 7.143 | 84.86 |
| AB200-R1a-Fab(hCDR3) | DIQMTQSPSSLSASVGDRVTITCSASQDISNYLNWYQQKPGKAPKLLIYYTSNLHSGVPSRFSGS GSGTDFTLTISSLQPEDFATYYCQQSYSTPWTFGQGTKLEIKRTVAAPSVFIFPPSDEQLKSGTA SVVCLLNNFYPREAKVQWKVDNALQSGNSQESVTEQDSKDSTYSLSSTLTLSKADYEKHKVYA CEVTHQGLSSPVTKSFNRGEC (SEQ ID NO: 173) | 82.755 | 112.654 | 84.76 |

**$K_d$ determined at 200 nM antigen concentration, hsBCMA (human BCMA), RhBCMA (Rhesus monkey BCMA)

TABLE 39

Heavy Chain Screening (Round 1): Fab fragment sequences

Light chain (Fab) amino acid sequence paired with listed heavy chain clones (AB200_VK6): DIQMTQSPSSLSASVGDRVTITCSATQDISNYLNWYQQKPGKAPKLLIYFTSNLQSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 174)

| Clone ID | Heavy chain (Fab) amino acid sequence | $K_d$ hsBCMA (nM) | $K_d$ RhBCMA (nM) | $T_m$ (° C.) |
|---|---|---|---|---|
| AB200-R1a-Fab_VH1 | QVQLVQSGAEVKKPGSSVKVSCKASGGTFSNYWMHWVRQAPGQGLEWMGATYRGHSETYYNEKFKGRVTITADKSTSTAYMELSSLRSEDTAVYYCARGAIYHGYDVLDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 175) | 21.012 | 32.151 | 82.955 |
| AB200-R1a-Fab_VH2 | QVQLVQSGAEVKKPGSSVKVSCKASGGTFSNYWMHWVRQAPGQGLEWMGATYRGHSDTYYNQKFQGRVTITADKSTSTAYMELSSLRSEDTAVYYCARGAVFHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 176) | 2.845 | 11.102 | 80.784 |
| AB200-R1a-Fab_VH3 | QVQLVQSGAEVKKPGSSVKVSCKASGGTFSNYWMSWVRQAPGQGLEWMGATYRGHSQTYYNQKFKGRVTITADKSTSTAYMELSSLRSEDTAVYYCARGAVYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 177) | 53.078 | | 78.657 |
| AB200-R1a-Fab_VH4 | QVQLVQSGAEVKKPGSSVKVSCKATGGTFSNYWMHWVRQAPGQGLEWMGATYRGHSNTYYDQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 178) | 5.448 | 13.679 | 78.011 |
| AB200-R1a-Fab_VH5 | QVQLVQSGAEVKKPGSSVKVSCKASGGTFSNYWMHWVRQAPGQGLEWMGATYRGHSDSNYNNKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 179) | 21.053 | 23.422 | 78.702 |
| AB200-R1a-Fab_VH6 | QVQLVQSGAEVKKPGSSVKVSCKASGGTFSNYWMHWVRQAPGQGLEWMGAIYRGHSDTYYNQKFKSRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 180) | | | 82.177 |
| AB200-R1a-Fab_VH7 | QVQLVQSGAEVKKPGSSVKVSCKASGGTFSNYWMHWVRQAPGQGLEWMGATYRGHGDTYYNHKFKGRVTITADKSTSTAYMELSSLRSEDTAVYYCARGAIYHGYNVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 181) | | | 83.562 |
| AB200-R1a-Fab_VH8 | QVQLVQSGAEVKKPGSSVKVSCKASGGTFSNYWMHWVRQAPGQGLEWMGATYRSHSDTYYNQKFKGRVTITADESTSTAYMELSSLRSEDTAVYYCARGAIFHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 182) | 0.948 | 3.137 | 81.348 |
| AB200-R1a-Fab_VH9 | QVQLVQSGAEVKKPGSSVKVSCKASGGTFSSYWMQWVRQAPGQGLEWMGATYRGHSDTYFNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 183) | | | |
| AB200-R1a-Fab_VH10 | QVQLVQSGAEVKKPGSSVKVSCKASGGTFSNYWLHWVRQAPGQGLEWMGAIYRGHSDAYYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 184) | | | 84.322 |
| AB200-R1a-Fab_VH11 | QVQLVQSGAEVKKPGSSVKVSCKASGGTFSNFWMHWVRQAPGQGLEWMGATYRGHSDTYYDQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 185) | | | 78.319 |
| AB200-R1a-Fab_VH12 | QVQLVQSGAEVKKPGSSVKVSCKASGGTFSNYWMHWVRQAPGQGLEWMGATIRSHSDTYYNNKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 186) | | | 80.154 |
| AB200-R1a-Fab_VH13 | QVQLVQSGAEVKKPGSSVKVSCKASGGTFSNYWMHWVRQAPGQGLEWMGATYRGHSTTYYAQKYKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 187) | 5.384 | 12.860 | 79.465 |

TABLE 39-continued

Heavy Chain Screening (Round 1): Fab fragment sequences

| Name | Sequence | | | |
|---|---|---|---|---|
| AB200-R1a-Fab_VH14 | QVQLVQSGAEVKKPGSSVKVSCKASGGTFSNYWMHWVRQAPGQGLEWMGGTYRGHTDTYYNYRGRVTITADKSTSTAYMELSSLRSEDTAVYYCARGAIYHGYNVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 188) | | | 82.583 |
| AB200-R1a-Fab_VH15 | QVQLVQSGAEVKKPGSSVKVSCKASGGTYSNYWMHWVRQAPGQGLEWMGATYRGHSDAYYNQRFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 189) | 11.657 | 17.136 | 79.976 |
| AB200-R1a-Fab_VH16 | QVQLVQSGAEVKKPGSSVKVSCKASGGTFSTYWMHWVRQAPGQGLEWMGATYRIHSDTYYNQKFKGRVTITADESTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 190) | 14.325 | 15.214 | 80.661 |
| AB200-R1a-Fab_VH17 | QVQLVQSGAEVKKPGSSVKVSCKASGGTFSSYWMHWVRQAPGQGLEWMGATYRGHSDTYYAQKFKGRVTITADKSTSTAYMELSSLRSEDTAVYYCARGAIYHGYEVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 191) | 82.742 | 70.157 | 80.449 |
| AB200-R1a-Fab_VH18 | QVQLVQSGAEVKKPGSSVKVSCKASGGTFSNYWMHWVRQAPGQGLEWMGATYKGHSDTYYNQKFKGRVTITADESTSTAYMELSSLRSEDTAVYYCARGAIYHGYEVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 192) | 7.732 | 10.644 | 82.877 |
| AB200-R1a-Fab_VH19 | QVQLVQSGAEVKKPGSSVKVSCKASGGSFSNYWMQWVRQAPGQGLEWMGATYRGHSDTYYNQKFKGRVTITADKSTSTAYMELSSLRSEDTAVYYCARGSIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 193) | 18.492 | 35.560 | 77.727 |
| AB200-R1a-Fab_VH20 | QVQLVQSGAEVKKPGSSVKVSCKASGGTFSNYWMHWVRQAPGQGLEWMGATIRGHSQTYYNQKFQGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 194) | 10.533 | 15.148 | 81.584 |
| AB200-R1a-Fab_VH21 | QVQLVQSGAEVKKPGSSVKVSCKASGGTFSNYAMHWVRQAPGQGLEWMGATYRGQSDTYYNQKYKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 195) | 5.231 | 11.143 | 82.366 |
| AB200-R1a-Fab_VH22 | QVQLVQSGAEVKKPGSSVKVSCKASGGTFSNYWMSWVRQAPGQGLEWMGATYRGHDTYYNEKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 196) | | | 78.908 |
| AB200-R1a-Fab_VH23 | QVQLVQSGAEVKKPGSSVKVSCKASGGTFSNYYMHWVRQAPGQGLEWMGATYRGHSDTFYAQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 197) | 20.439 | 19.865 | 79.077 |
| AB200-R1a-Fab_VH24 | QVQLVQSGAEVKKPGSSVKVSCKASGGTFTNYWMHWVRQAPGQGLEWMGATYRGHSNTYYNQKFKGRVTITADKSTSTAYMELSSLRSEDTAVYYCARGAIYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 198) | 13.085 | 24.532 | 81.423 |
| AB200-R1a-Fab_VH25 | QVQLVQSGAEVKKPGSSVKVSCKASGGTFSNYAMHWVRQAPGQGLEWMGATYRGHSDTYYNQKFKGRVTITADKSTSTAYMELSSLRSEDTAVYYCARGSLYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 199) | | | 85.115 |
| AB200-R1a-Fab_VH26 | QVQLVQSGAEVKKPGSSVKVSCKASGGSFSNYWMHWVRQAPGQGLEWMGATYRIHSDTFYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 200) | 0.926 | 2.311 | 79.749 |
| AB200-R1a-Fab_VH27 | QVQLVQSGAEVKKPGSSVKVSCKATGGTFSNYWMHWVRQAPGQGLEWMGAIYRGHSDTYYNQKFRGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 201) | 3.804 | 7.845 | 83.141 |
| AB200-R1a-Fab_VH28 | QVQLVQSGAEVKKPGSSVKVSCKASGGTFSNYWMHWVRQAPGQGLEWMGASYRGHSDTYYNQKFQGRVTITADKSTSTAYMELSSLRSEDTAVYYCARGAIYHGYDVLNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 202) | | | |

TABLE 39-continued

Heavy Chain Screening (Round 1): Fab fragment sequences

| | | | | |
|---|---|---|---|---|
| AB200-R1a-Fab_VH29 | QVQLVQSGAEVKKPGSSVKVSCKASGGTFSTYWMHWVRQAPGQGLEWMGATYRGHSDSY YNQKFKGRVTITADKSTSTAYMELSSLRSEDTAVYYCARGALYHGYDVLDNWGQGTLVTVSS ASTKGPSVFPLAPSSKSTSGGTAALGCLVKDYFPEPVTVSWNSGALTSGVHTFPAVLQSSGLY SLSSVVTVPSSSLGTQTYICNVNHKPSNTKVDKKVEPKSC (SEQ ID NO: 203) | | | 81.001 |
| AB200-R1a-Fab_VH30 | QVQLVQSGAEVKKPGSSVKVSCKASGGTYSNYWMHWVRQAPGQGLEWMGATYRGHTDTY YNQKFKGRVTITADKSTSTAYMELSSLRSEDTAVYYCARGAIYHGYDVMDNWGQGTLVTVSS ASTKGPSVFPLAPSSKSTSGGTAALGCLVKDYFPEPVTVSWNSGALTSGVHTFPAVLQSSGLY SLSSVVTVPSSSLGTQTYICNVNHKPSNTKVDKKVEPKSC (SEQ ID NO: 204) | 22.287 | 28.179 | 79.922 |
| AB200-R1a-Fab_VH31 | QVQLVQSGAEVKKPGSSVKVSCKASGGTFSNYWMHWVRQAPGQGLEWMGGTYRGHSDTY FNQKFKGRVTITADKSTSTAYMELSSLRSEDTAVYYCARGAIYHGFDVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 205) | 9.056 | 19.178 | 79.560 |
| AB200-R1a-Fab_VH32 | QVQLVQSGAEVKKPGSSVKVSCKASGGTFSNYWMHWVRQAPGQGLEWMGATYRSHSDTY YNQKFKSRVTITADKSTSTAYMELSSLRSEDTAVYYCARGAIYHGYDVIDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 206) | 1.088 | 4.169 | 78.112 |
| AB200-R1a-Fab_VH33 | QVQLVQSGAEVKKPGSSVKVSCKASGGTFTNFWMHWVRQAPGQGLEWMGATYRGQSDTY YNQKFKGRVTITADKSTSTAYMELSSLRSEDTAVYYCARGAIYHGYDVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 207) | 1.434 | 5.124 | 82.085 |
| AB200-R1a-Fab_VH34 | QVQLVQSGAEVKKPGSSVKVSCKASGGTFSNYYLHWVRQAPGQGLEWMGATYRGHSDTYY NQKFKGRVTITADKSTSTAYMELSSLRSEDTAVYYCARGAIYNGYDVLDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 208) | 18.883 | 13.192 | 82.908 |
| AB200-R1a-Fab_VH35 | QVQLVQSGAEVKKPGSSVKVSCKASGGTFSNYWIHWVRQAPGQGLEWMGATFKGHSDTYY NQKFKGRVTITADKSTSTAYMELSSLRSEDTAVYYCARGAIYHGYDVLDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 209) | 8.503 | 9.493 | 84.851 |
| AB200-R1a-Fab_VH36 | QVQLVQSGAEVKKPGSSVKVSCKASGGTFSNYWMHWVRQAPGQGLEWMGATFRGHSDTY YNHKFKGRVTITADKSTSTAYMELSSLRSEDTAVYYCARGAIYHGFDVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 210) | 28.079 | 45.440 | 82.674 |
| AB200-R1a-Fab_VH37 | QVQLVQSGAEVKKPGSSVKVSCKASGGTFTNYWMHWVRQAPGQGLEWMGATYKGHSDTY YNQKFRGRVTITADKSTSTAYMELSSLRSEDTAVYYCARGAIYHGYDVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 211) | 5.276 | 10.351 | 81.688 |
| AB200-R1a-Fab_VH38 | QVQLVQSGAEVKKPGSSVKVSCKASGGTFSNYWMHWVRQAPGQGLEWMGATYRGHSDTY FNQKFKGRVTITADKSTSTAYMELSSLRSEDTAVYYCARGAIFHGYDVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 212) | 4.119 | 12.098 | 80.903 |
| AB200-R1a-Fab_VH39 | QVQLVQSGAEVKKPGSSVKVSCKASGGTFSDYWMHWVRQAPGQGLEWMGATIRGHSDTYY NQKFKGRVTITADKSTSTAYMELSSLRSEDTAVYYCARGAIYHGYDVLENWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 213) | | | 81.312 |
| AB200-R1a-Fab_VH40 | QVQLVQSGAEVKKPGSSVKVSCKASGGTFSNFWMHWVRQAPGQGLEWMGATYRGHSDTY YNHKFKGRVTITADKSTSTAYMELSSLRSEDTAVYYCARGAIYHGYDVLENWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 214) | 17.248 | 45.262 | 82.339 |
| AB200-R1a-Fab_VH41 | QVQLVQSGAEVKKPGSSVKVSCKASGGTFSNYWMHWVRQAPGQGLEWMGATYRGHSDTY YNEKFKGRVTITADKSTSTAYMELSSLRSEDTAVYYCARGAIYHGYDILNNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 215) | 14.451 | | 79.430 |
| AB200-R1a-Fab_VH42 | QVQLVQSGAEVKKPGSSVKVSCKASGGTFSNYWMHWVRQAPGQGLEWMGATYRGHSTTY YNQKFKGRVTITADKSTSTAYMELSSLRSEDTAVYYCARGSIYHGYDVMDNWGQGTLVTVSS ASTKGPSVFPLAPSSKSTSGGTAALGCLVKDYFPEPVTVSWNSGALTSGVHTFPAVLQSSGLY SLSSVVTVPSSSLGTQTYICNVNHKPSNTKVDKKVEPKSC (SEQ ID NO: 216) | 28.430 | 15.520 | 82.125 |
| AB200-R1a-Fab_VH43 | QVQLVQSGAEVKKPGSSVKVSCKASGGTFSNYWMHWVRQAPGQGLEWMGATYRGHSQTY YNQKFKGRVTITADKSTSTAYMELSSLRSEDTAVYYCARGTIYHGYDILDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 217) | | | 82.855 |

TABLE 39-continued

Heavy Chain Screening (Round 1): Fab fragment sequences

| | | | | |
|---|---|---|---|---|
| AB200-R1a-Fab_VH44 | QVQLVQSGAEVKKPGSSVKVSCKASGGTFSNYWMHWVRQAPGQGLEWMGGTYRGHSDTY YNQRFKGRVTITADKSTSTAYMELSSLRSEDTAVYYCARGAIYHGYDILDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 218) | 29.042 | 8.608 | 79.892 |
| AB200-R1a-Fab_VH45 | QVQLVQSGAEVKKPGSSVKVSCKASGGTFSNYWMHWVRQAPGQGLEWMGATYRGHSDTY YNNKFKGRVTITADKSTSTAYMELSSLRSEDTAVYYCARGAIYHGYDVLEDWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 219) | 21.147 | 44.940 | 81.742 |
| AB200-R1a-Fab_VH46 | QVQLVQSGAEVKKPGSSVKVSCKASGGTFSNYWMHWVRQAPGQGLEWMGATYRGHSDTN YNQKYKGRVTITADKSTSTAYMELSSLRSEDTAVYYCARGAIYNGYDVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 220) | 11.607 | 19.985 | 79.871 |
| AB200-R1a-Fab_VH47 | QVQLVQSGAEVKKPGSSVKVSCKASGGTFSNYWLHWVRQAPGQGLEWMGATYRGHSDTYY DQKFKGRVTITADKSTSTAYMELSSLRSEDTAVYYCARGALYHGYDVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 221) | | | 79.099 |
| AB200-R1a-Fab_VH48 | QVQLVQSGAEVKKPGSSVKVSCKASGGTFSDYWMHWVRQAPGQGLEWMGATYRGHSDTY YNQRFKGRVTITADKSTSTAYMELSSLRSEDTAVYYCARGAIYHGYDVMDNWGQGTLVTVSS ASTKGPSVFPLAPSSKSTSGGTAALGCLVKDYFPEPVTVSWNSGALTSGVHTFPAVLQSSGLY SLSSVVTVPSSSLGTQTYICNVNHKPSNTKVDKKVEPKSC (SEQ ID NO: 222) | 34.497 | 25.017 | 80.234 |
| AB200-R1a-Fab_VH49 | QVQLVQSGAEVKKPGSSVKVSCKASGGTFSNYWIHWVRQAPGQGLEWMGASYRGHSDTYY NQKFKGRVTITADKSTSTAYMELSSLRSEDTAVYYCARGAIYHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 223) | 6.718 | 15.613 | 83.392 |
| AB200-R1a-Fab_VH50 | QVQLVQSGAEVKKPGSSVKVSCKASGGTFSNYWMHWVRQAPGQGLEWMGATFRGHSDTY YNQKFKSRVTITADKSTSTAYMELSSLRSEDTAVYYCARGAIYHGYDVLDNWGQGTLVTVSS ASTKGPSVFPLAPSSKSTSGGTAALGCLVKDYFPEPVTVSWNSGALTSGVHTFPAVLQSSGLY SLSSVVTVPSSSLGTQTYICNVNHKPSNTKVDKKVEPKSC (SEQ ID NO: 224) | 4.669 | 9.654 | 80.428 |
| AB200-R1a-Fab_VH51 | QVQLVQSGAEVKKPGSSVKVSCKASGGTFSNYWMHWVRQAPGQGLEWMGATYRGHSDTN YNQKFKGRVTITADKSTSTAYMELSSLRSEDTAVYYCARGTIYHGFDVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 225) | 18.869 | | 79.502 |
| AB200-R1a-Fab_VH52 | QVQLVQSGAEVKKPGSSVKVSCKASGGSFSDYWMHWVRQAPGQGLEWMGATYRGHSTTY YNQKFKGRVTITADKSTSTAYMELSSLRSEDTAVYYCARGAIYHGYDVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 226) | 17.985 | 24.632 | 82.845 |
| AB200-R1a-Fab_VH53 | QVQLVQSGAEVKKPGSSVKVSCKASGGTFSNYWMQWVRQAPGQGLEWMGATYRGHTETY YNQKFKGRVTITADKSTSTAYMELSSLRSEDTAVYYCARGAIYHGYDVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 227) | | | 78.416 |
| AB200-R1a-Fab_VH54 | QVQLVQSGAEVKKPGSSVKVSCKASGGTFSNYWMHWVRQAPGQGLEWMGATYRGHGDTF YNQKFKGRVTITADKSTSTAYMELSSLRSEDTAVYYCARGAIYHGYDVLNNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 228) | 12.013 | 20.810 | 79.432 |
| AB200-R1a-Fab_VH55 | QVQLVQSGAEVKKPGSSVKVSCKASGGTFSTYWMHWVRQAPGQGLEWMGATYRGQSDTY YNQKFKGRVTITADKSTSTAYMELSSLRSEDTAVYYCARGAIYHGYEVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 229) | | | 82.925 |
| AB200-R1a-Fab_VH56 | QVQLVQSGAEVKKPGSSVKVSCKASGGTFSNYWIHWVRQAPGQGLEWMGATYRGHSDTYY NQKFRGRVTITADKSTSTAYMELSSLRSEDTAVYYCARGTIYHGYDVLDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 230) | 20.680 | 17.994 | 84.368 |
| AB200-R1a-Fab_VH57 | QVQLVQSGAEVKKPGSSVKVSCKASGGTYSNYYMHWVRQAPGQGLEWMGATYRGHSETYY NQKFKGRVTITADKSTSTAYMELSSLRSEDTAVYYCARGAIYHGYDVLDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 231) | 11.087 | 11.964 | 80.273 |
| AB200-R1a-Fab_VH58 | QVQLVQSGAEVKKPGSSVKVSCKASGGTFSNYWMSWVRQAPGQGLEWMGATYRGHSNAY YNQKFKGRVTITADKSTSTAYMELSSLRSEDTAVYYCARGAIYHGYDVLDNWGQGTLVTVSSA STKGPSVFPLAPSSKSTSGGTAALGCLVKDYFPEPVTVSWNSGALTSGVHTFPAVLQSSGLYS LSSVVTVPSSSLGTQTYICNVNHKPSNTKVDKKVEPKSC (SEQ ID NO: 232) | | | 78.151 |

TABLE 39-continued

Heavy Chain Screening (Round 1): Fab fragment sequences

| | | | | |
|---|---|---|---|---|
| AB200-R1a-Fab_VH59 | QVQLVQSGAEVKKPGSSVKVSCKATGGTFSNYAMHWVRQAPGQGLEWMGASYRGHSDTYY NQKFKGRVTITADKSTSTAYMELSSLRSEDTAVYYCARGAIYHGYDVLDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 233) | 26.159 | 28.312 | 84.514 |
| AB200-R1a-Fab_VH60 | QVQLVQSGAEVKKPGSSVKVSCKASGGTFSSYWMHWVRQAPGQGLEWMGATYRIHSDSYY NQKFKGRVTITADKSTSTAYMELSSLRSEDTAVYYCARGAIYHGYDVLDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 234) | 13.568 | 17.766 | 79.241 |

**$K_d$ determined at 200 nM antigen concentration, hsBCMA (human BCMA), RhBCMA (Rhesus monkey BCMA)

TABLE 40

Light Chain Screening (Round 2): Fab fragment sequences

| | |
|---|---|
| Heavy chain (Fab) amino acid sequence paired with listed light chain clones (AB200_R1_VH26) | QVQLVQSGAEVKKPGSSVKVSCKASGGSFSNYWMHWVRQAPGQGLEWMGATYRIHSDTFYNQKFKGRV TITADKSTSTAYMELSSLRSEDTAVYYCARGAIYHGYDVLDNWGQGTLVTVSSASTKGPSVFPLAPSS KSTSGGTAALGCLVKDYFPEPVTVSWNSGALTSGVHTFPAVLQSSGLYSLSSVVTVPSSSLGTQTYIC NVNHKPSNTKVDKKVEPKSC (SEQ ID NO: 235) |

| Clone ID | Light chain (Fab) amino acid sequence | $K_d$ hsBCMA (nM) | $K_d$ RhBCMA (nM) | $T_m$ (° C.) |
|---|---|---|---|---|
| AB200-R1H26-R2Vk1 | DIQMTQSPSSLSASVGDRVTITCRASQSISSYLNWYQQKPGKAPKLLIYAASSLQSGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 236) | 2.043 | | 82.409 |
| AB200-R1H26-R2Vk2 | DIQMTQSPSSLSASVGDRVTITCRASQSISSYINWYQQKPGKAPKLLIYAASSLQSGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 237) | 2.369 | | 82.119 |
| AB200-R1H26-R2Vk3 | DIQMTQSPSSLSASVGDRVTITCRASQSISSYLNWYQQKPGKAPKLLIYATSNLQSGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 238) | 1.623 | | 82.928 |
| AB200-R1H26-R2Vk4 | DIQMTQSPSSLSASVGDRVTITCRASQSISSYLNWYQQKPGKAPKLLIYATSNIQSGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 239) | 1.703 | | 81.832 |
| AB200-R1H26-R2Vk5 | DIQMTQSPSSLSASVGDRVTITCRASQSISSYLNWYQQKPGKAPKLLIYATSNLQIGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 240) | 1.286 | | 82.925 |
| AB200-R1H26-R2Vk6 | DIQMTQSPSSLSASVGDRVTITCRASQSISSYINWYQQKPGKAPKLLIYATSNLQSGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 241) | 2.077 | | 82.640 |
| AB200-R1H26-R2Vk7 | DIQMTQSPSSLSASVGDRVTITCRASQSISSYINWYQQKPGKAPKLLIYATSNIQSGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 242) | 2.167 | | 81.764 |
| AB200-R1H26-R2Vk8 | DIQMTQSPSSLSASVGDRVTITCRASQSISSYINWYQQKPGKAPKLLIYATSNLQIGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 243) | 1.687 | | 82.921 |
| AB200-R1H26-R2Vk9 | DIQMTQSPSSLSASVGDRVTITCRASQSISSYLNWYQQKPGKAPKLLIYAASSLQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 244) | 2.347 | | 79.850 |

TABLE 40-continued

Light Chain Screening (Round 2): Fab fragment sequences

| | | | |
|---|---|---|---|
| AB200-R1H26-R2Vk10 | DIQMTQSPSSLSASVGDRVTITCRASQSISSYLNWYQQKPGKAPKLLIYAASSLQSGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 245) | 3.228 | 80.527 |
| AB200-R1H26-R2Vk11 | DIQMTQSPSSLSASVGDRVTITCRASQSISSYLNWYQQKPGKAPKLLIYAASSLQSGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 246) | 1.553 | 82.940 |
| AB200-R1H26-R2Vk12 | DIQMTQSPSSLSASVGDRVTITCRASQSISSYLNWYQQKPGKAPKLLIYAASSLQSGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 247) | 3.724 | 79.775 |
| AB200-R1H26-R2Vk13 | DIQMTQSPSSLSASVGDRVTITCRASQSISSYLNWYQQKPGKAPKLLIYAASSLQSGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 248) | 3.020 | 83.187 |
| AB200-R1H26-R2Vk14 | DIQMTQSPSSLSASVGDRVTITCRASQSISSYINWYQQKPGKAPKLLIYAASSLQSGVPSRFSG SGSGTDFTLTISSLQPEDFATYYCQQFRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 249) | 2.522 | 79.433 |
| AB200-R1H26-R2Vk15 | DIQMTQSPSSLSASVGDRVTITCRASQSISSYINWYQQKPGKAPKLLIYAASSLQSGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 250) | 3.273 | 80.321 |
| AB200-R1H26-R2Vk16 | DIQMTQSPSSLSASVGDRVTITCRASQSISSYINWYQQKPGKAPKLLIYAASSLQSGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 251) | 2.090 | 83.455 |
| AB200-R1H26-R2Vk17 | DIQMTQSPSSLSASVGDRVTITCRASQSISSYINWYQQKPGKAPKLLIYAASSLQSGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 252) | 3.594 | 78.993 |
| AB200-R1H26-R2Vk18 | DIQMTQSPSSLSASVGDRVTITCRASQSISSYINWYQQKPGKAPKLLIYAASSLQSGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 253) | 3.435 | 82.729 |
| AB200-R1H26-R2Vk19 | DIQMTQSPSSLSASVGDRVTITCRASQSISSYLNWYQQKPGKAPKLLIYATSNLQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 254) | 1.623 | 79.896 |
| AB200-R1H26-R2Vk20 | DIQMTQSPSSLSASVGDRVTITCRASQSISSYLNWYQQKPGKAPKLLIYATSNLQSGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 255) | 2.104 | 81.004 |
| AB200-R1H26-R2Vk21 | DIQMTQSPSSLSASVGDRVTITCRASQSISSYLNWYQQKPGKAPKLLIYATSNLQSGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 256) | 1.275 | 84.095 |
| AB200-R1H26-R2Vk22 | DIQMTQSPSSLSASVGDRVTITCRASQSISSYLNWYQQKPGKAPKLLIYATSNLQSGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 257) | 2.244 | 79.661 |
| AB200-R1H26-R2Vk23 | DIQMTQSPSSLSASVGDRVTITCRASQSISSYLNWYQQKPGKAPKLLIYATSNLQSGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 258) | 2.280 | 83.321 |
| AB200-R1H26-R2Vk24 | DIQMTQSPSSLSASVGDRVTITCRASQSISSYLNWYQQKPGKAPKLLIYATSNIQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 259) | 1.625 | 79.357 |

TABLE 40-continued

Light Chain Screening (Round 2): Fab fragment sequences

| | | | |
|---|---|---|---|
| AB200-R1H26-R2Vk25 | DIQMTQSPSSLSASVGDRVTITCRASQSISSYLNWYQQKPGKAPKLLIYATSNIQSGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 260) | 2.044 | 80.300 |
| AB200-R1H26-R2Vk26 | DIQMTQSPSSLSASVGDRVTITCRASQSISSYLNWYQQKPGKAPKLLIYATSNIQSGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 261) | 1.456 | 83.451 |
| AB200-R1H26-R2Vk27 | DIQMTQSPSSLSASVGDRVTITCRASQSISSYLNWYQQKPGKAPKLLIYATSNIQSGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 262) | 2.332 | 79.104 |
| AB200-R1H26-R2Vk28 | DIQMTQSPSSLSASVGDRVTITCRASQSISSYLNWYQQKPGKAPKLLIYATSNIQSGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 263) | 2.680 | 82.966 |
| AB200-R1H26-R2Vk29 | DIQMTQSPSSLSASVGDRVTITCRASQSISSYLNWYQQKPGKAPKLLIYATSNLQIGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 264) | 1.179 | 80.138 |
| AB200-R1H26-R2Vk30 | DIQMTQSPSSLSASVGDRVTITCRASQSISSYLNWYQQKPGKAPKLLIYATSNLQIGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 265) | 1.741 | 81.085 |
| AB200-R1H26-R2Vk31 | DIQMTQSPSSLSASVGDRVTITCRASQSISSYLNWYQQKPGKAPKLLIYATSNLQIGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 266) | 1.099 | 83.337 |
| AB200-R1H26-R2Vk32 | DIQMTQSPSSLSASVGDRVTITCRASQSISSYLNWYQQKPGKAPKLLIYATSNLQIGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 267) | 1.931 | 80.094 |
| AB200-R1H26-R2Vk33 | DIQMTQSPSSLSASVGDRVTITCRASQSISSYLNWYQQKPGKAPKLLIYATSNLQIGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 268) | 1.737 | 83.936 |
| AB200-R1H26-R2Vk34 | DIQMTQSPSSLSASVGDRVTITCRASQSISSYINWYQQKPGKAPKLLIYATSNLQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 269) | 1.548 | 79.150 |
| AB200-R1H26-R2Vk35 | DIQMTQSPSSLSASVGDRVTITCRASQSISSYINWYQQKPGKAPKLLIYATSNLQSGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 270) | 1.759 | 79.657 |
| AB200-R1H26-R2Vk36 | DIQMTQSPSSLSASVGDRVTITCRASQSISSYINWYQQKPGKAPKLLIYATSNLQSGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 271) | 1.665 | 84.360 |
| AB200-R1H26-R2Vk37 | DIQMTQSPSSLSASVGDRVTITCRASQSISSYINWYQQKPGKAPKLLIYATSNLQSGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 272) | 2.302 | 79.374 |
| AB200-R1H26-R2Vk38 | DIQMTQSPSSLSASVGDRVTITCRASQSISSYINWYQQKPGKAPKLLIYATSNLQSGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 273) | 2.855 | 83.791 |
| AB200-R1H26-R2Vk39 | DIQMTQSPSSLSASVGDRVTITCRASQSISSYINWYQQKPGKAPKLLIYATSNIQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 274) | 1.835 | 78.907 |

TABLE 40-continued

Light Chain Screening (Round 2): Fab fragment sequences

| | | | |
|---|---|---|---|
| AB200-R1H26-R2Vk40 | DIQMTQSPSSLSASVGDRVTITCRASQSISSYINWYQQKPGKAPKLLIYATSNIQSGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 275) | 2.337 | 79.308 |
| AB200-R1H26-R2Vk41 | DIQMTQSPSSLSASVGDRVTITCRASQSISSYINWYQQKPGKAPKLLIYATSNIQSGVPSRFSGSGSGTDFTLTISSLQPEDFATYYCQQFRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 276) | 1.867 | 83.256 |
| AB200-R1H26-R2Vk42 | DIQMTQSPSSLSASVGDRVTITCRASQSISSYINWYQQKPGKAPKLLIYATSNIQSGVPSRFSGSGSGTDFTLTISSLQPEDFATYYCQQYRKIPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 277) | 2.423 | 78.411 |
| AB200-R1H26-R2Vk43 | DIQMTQSPSSLSASVGDRVTITCRASQSISSYINWYQQKPGKAPKLLIYATSNIQSGVPSRFSGSGSGTDFTLTISSLQPEDFATYYCQQFRKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 278) | 3.228 | 82.001 |
| AB200-R1H26-R2Vk44 | DIQMTQSPSSLSASVGDRVTITCRASQSISSYINWYQQKPGKAPKLLIYATSNLQIGVPSRFSGSGSGTDFTLTISSLQPEDFATYYCQQYRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 279) | 1.282 | 79.402 |
| AB200-R1H26-R2Vk45 | DIQMTQSPSSLSASVGDRVTITCRASQSISSYINWYQQKPGKAPKLLIYATSNLQIGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 280) | 1.569 | 80.255 |
| AB200-R1H26-R2Vk46 | DIQMTQSPSSLSASVGDRVTITCRASQSISSYINWYQQKPGKAPKLLIYATSNLQIGVPSRFSGSGSGTDFTLTISSLQPEDFATYYCQQFRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 281) | 1.354 | 83.993 |
| AB200-R1H26-R2Vk47 | DIQMTQSPSSLSASVGDRVTITCRASQSISSYINWYQQKPGKAPKLLIYATSNLQIGVPSRFSGSGSGTDFTLTISSLQPEDFATYYCQQYRKIPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 282) | 1.726 | 78.634 |
| AB200-R1H26-R2Vk48 | DIQMTQSPSSLSASVGDRVTITCRASQSISSYINWYQQKPGKAPKLLIYATSNLQIGVPSRFSGSGSGTDFTLTISSLQPEDFATYYCQQFRKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 283) | 2.307 | 83.862 |

TABLE 41

Light Chain Screening (Round 2): Fab fragment sequences

| | |
|---|---|
| Heavy chain (Fab) amino acid sequence paired with listed light chain clones (AB200_R1_VH32) | QVQLVQSGAEVKKPGSSVKVSCKASGGTFSNYWMHWVRQAPGQGLEWMGATYRSHSDTYYNQKFKSRVTITADKSTSTAYMELSSLRSEDTAVYYCARGAIYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 284) |

| Clone ID | Light chain (Fab) amino acid sequence | $K_d$ hsBCMA (nM) | $K_d$ RhBCMA (nM) | $T_m$ (° C.) |
|---|---|---|---|---|
| AB200-R1H32-R2Vk1 | DIQMTQSPSSLSASVGDRVTITCRASQSISSYLNWYQQKPGKAPKLLIYAASSLQSGVPSRFSGSGSGTDFTLTISSLQPEDFATYYCQQFRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 285) | 1.267 | 5.418 | 79.956 |
| AB200-R1H32-R2Vk2 | DIQMTQSPSSLSASVGDRVTITCRASQSISSYINWYQQKPGKAPKLLIYAASSLQSGVPSRFSGSGSGTDFTLTISSLQPEDFATYYCQQFRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 286) | 1.476 | 5.498 | 79.715 |

TABLE 41-continued

Light Chain Screening (Round 2): Fab fragment sequences

| | | | | |
|---|---|---|---|---|
| AB200-R1H32-R2Vk3 | DIQMTQSPSSLSASVGDRVTITCRASQSISSYLNWYQQKPGKAPKLLIYATSNLQSGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 287) | 1.007 | 4.375 | 80.665 |
| AB200-R1H32-R2Vk4 | DIQMTQSPSSLSASVGDRVTITCRASQSISSYLNWYQQKPGKAPKLLIYATSNIQSGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 288) | 1.144 | 5.599 | 79.449 |
| AB200-R1H32-R2Vk5 | DIQMTQSPSSLSASVGDRVTITCRASQSISSYLNWYQQKPGKAPKLLIYATSNLQIGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 289) | 0.882 | 5.661 | 80.573 |
| AB200-R1H32-R2Vk6 | DIQMTQSPSSLSASVGDRVTITCRASQSISSYINWYQQKPGKAPKLLIYATSNLQSGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 290) | 1.226 | 4.631 | 79.773 |
| AB200-R1H32-R2Vk7 | DIQMTQSPSSLSASVGDRVTITCRASQSISSYINWYQQKPGKAPKLLIYATSNIQSGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 291) | 1.266 | 4.995 | 79.001 |
| AB200-R1H32-R2Vk8 | DIQMTQSPSSLSASVGDRVTITCRASQSISSYINWYQQKPGKAPKLLIYATSNLQIGVPSRFSG SGSGTDFTLTISSLQPEDFATYYCQQFRKLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 292) | 0.920 | 3.589 | 80.002 |
| AB200-R1H32-R2Vk9 | DIQMTQSPSSLSASVGDRVTITCRASQSISSYLNWYQQKPGKAPKLLIYAASSLQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 293) | 1.428 | 7.379 | 78.040 |
| AB200-R1H32-R2Vk10 | DIQMTQSPSSLSASVGDRVTITCRASQSISSYLNWYQQKPGKAPKLLIYAASSLQSGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 294) | 2.104 | 7.858 | 78.238 |
| AB200-R1H32-R2Vk11 | DIQMTQSPSSLSASVGDRVTITCRASQSISSYLNWYQQKPGKAPKLLIYAASSLQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 295) | 0.936 | 4.104 | 80.494 |
| AB200-R1H32-R2Vk12 | DIQMTQSPSSLSASVGDRVTITCRASQSISSYLNWYQQKPGKAPKLLIYAASSLQSGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 296) | 1.530 | 9.118 | 77.686 |
| AB200-R1H32-R2Vk13 | DIQMTQSPSSLSASVGDRVTITCRASQSISSYLNWYQQKPGKAPKLLIYAASSLQSGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 297) | 2.197 | 6.590 | 80.777 |
| AB200-R1H32-R2Vk14 | DIQMTQSPSSLSASVGDRVTITCRASQSISSYINWYQQKPGKAPKLLIYAASSLQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 298) | 1.323 | 6.049 | 77.375 |
| AB200-R1H32-R2Vk15 | DIQMTQSPSSLSASVGDRVTITCRASQSISSYINWYQQKPGKAPKLLIYAASSLQSGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 299) | 1.287 | 6.413 | 77.827 |
| AB200-R1H32-R2Vk16 | DIQMTQSPSSLSASVGDRVTITCRASQSISSYINWYQQKPGKAPKLLIYAASSLQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 300) | 1.172 | 4.536 | 80.595 |
| AB200-R1H32-R2Vk17 | DIQMTQSPSSLSASVGDRVTITCRASQSISSYINWYQQKPGKAPKLLIYAASSLQSGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 301) | 1.430 | 7.492 | 76.415 |

TABLE 41-continued

Light Chain Screening (Round 2): Fab fragment sequences

| | | | | |
|---|---|---|---|---|
| AB200-R1H32-R2Vk18 | DIQMTQSPSSLSASVGDRVTITCRASQSISSYINWYQQKPGKAPKLLIYAASSLQSGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 302) | 1.519 | 6.300 | 79.872 |
| AB200-R1H32-R2Vk19 | DIQMTQSPSSLSASVGDRVTITCRASQSISSYLNWYQQKPGKAPKLLIYATSNLQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 303) | 0.946 | 4.565 | 77.794 |
| AB200-R1H32-R2Vk20 | DIQMTQSPSSLSASVGDRVTITCRASQSISSYLNWYQQKPGKAPKLLIYATSNLQSGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 304) | 0.867 | 4.815 | 78.369 |
| AB200-R1H32-R2Vk21 | DIQMTQSPSSLSASVGDRVTITCRASQSISSYLNWYQQKPGKAPKLLIYATSNLQSGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 305) | 0.800 | 3.314 | 81.462 |
| AB200-R1H32-R2Vk22 | DIQMTQSPSSLSASVGDRVTITCRASQSISSYLNWYQQKPGKAPKLLIYATSNLQSGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 306) | 1.058 | 5.639 | 77.373 |
| AB200-R1H32-R2Vk23 | DIQMTQSPSSLSASVGDRVTITCRASQSISSYLNWYQQKPGKAPKLLIYATSNLQSGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 307) | 1.130 | 5.084 | 80.935 |
| AB200-R1H32-R2Vk24 | DIQMTQSPSSLSASVGDRVTITCRASQSISSYLNWYQQKPGKAPKLLIYATSNIQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 308) | 1.054 | 4.895 | 77.417 |
| AB200-R1H32-R2Vk25 | DIQMTQSPSSLSASVGDRVTITCRASQSISSYLNWYQQKPGKAPKLLIYATSNIQSGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 309) | 1.037 | 5.623 | 77.737 |
| AB200-R1H32-R2Vk26 | DIQMTQSPSSLSASVGDRVTITCRASQSISSYLNWYQQKPGKAPKLLIYATSNIQSGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 310) | 1.064 | 3.846 | 80.637 |
| AB200-R1H32-R2Vk27 | DIQMTQSPSSLSASVGDRVTITCRASQSISSYLNWYQQKPGKAPKLLIYATSNIQSGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 311) | 1.205 | 6.901 | 76.729 |
| AB200-R1H32-R2Vk28 | DIQMTQSPSSLSASVGDRVTITCRASQSISSYLNWYQQKPGKAPKLLIYATSNIQSGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 312) | 1.185 | 5.993 | 79.945 |
| AB200-R1H32-R2Vk29 | DIQMTQSPSSLSASVGDRVTITCRASQSISSYLNWYQQKPGKAPKLLIYATSNLQIGVPSRFSG SGSGTDFTLTISSLQPEDFATYYCQQYRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 313) | 1.141 | 3.690 | 77.447 |
| AB200-R1H32-R2Vk30 | DIQMTQSPSSLSASVGDRVTITCRASQSISSYLNWYQQKPGKAPKLLIYATSNLQIGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 314) | 0.816 | 3.915 | 78.131 |
| AB200-R1H32-R2Vk31 | DIQMTQSPSSLSASVGDRVTITCRASQSISSYLNWYQQKPGKAPKLLIYATSNLQIGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 315) | 0.665 | 2.821 | 81.248 |
| AB200-R1H32-R2Vk32 | DIQMTQSPSSLSASVGDRVTITCRASQSISSYLNWYQQKPGKAPKLLIYATSNLQIGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 316) | 0.873 | 4.825 | 77.189 |

TABLE 41-continued

Light Chain Screening (Round 2): Fab fragment sequences

| | | | | |
|---|---|---|---|---|
| AB200-R1H32-R2Vk33 | DIQMTQSPSSLSASVGDRVTITCRASQSISSYLNWYQQKPGKAPKLLIYATSNLQIGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 317) | 0.996 | 4.289 | 81.061 |
| AB200-R1H32-R2Vk34 | DIQMTQSPSSLSASVGDRVTITCRASQSISSYINWYQQKPGKAPKLLIYATSNLQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 318) | 1.123 | 4.531 | 76.682 |
| AB200-R1H32-R2Vk35 | DIQMTQSPSSLSASVGDRVTITCRASQSISSYINWYQQKPGKAPKLLIYATSNLQSGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 319) | 0.843 | 4.130 | 77.177 |
| AB200-R1H32-R2Vk36 | DIQMTQSPSSLSASVGDRVTITCRASQSISSYINWYQQKPGKAPKLLIYATSNLQSGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 320) | 0.830 | 3.451 | 81.115 |
| AB200-R1H32-R2Vk37 | DIQMTQSPSSLSASVGDRVTITCRASQSISSYINWYQQKPGKAPKLLIYATSNLQSGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 321) | 0.850 | 4.405 | 76.708 |
| AB200-R1H32-R2Vk38 | DIQMTQSPSSLSASVGDRVTITCRASQSISSYINWYQQKPGKAPKLLIYATSNLQSGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 322) | 1.153 | 5.351 | 80.727 |
| AB200-R1H32-R2Vk39 | DIQMTQSPSSLSASVGDRVTITCRASQSISSYINWYQQKPGKAPKLLIYATSNIQSGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 323) | 1.063 | 4.758 | 76.077 |
| AB200-R1H32-R2Vk40 | DIQMTQSPSSLSASVGDRVTITCRASQSISSYINWYQQKPGKAPKLLIYATSNIQSGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 324) | 1.032 | 5.079 | 76.379 |
| AB200-R1H32-R2Vk41 | DIQMTQSPSSLSASVGDRVTITCRASQSISSYINWYQQKPGKAPKLLIYATSNIQSGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 325) | 1.185 | 4.261 | 79.593 |
| AB200-R1H32-R2Vk42 | DIQMTQSPSSLSASVGDRVTITCRASQSISSYINWYQQKPGKAPKLLIYATSNIQSGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 326) | 1.045 | 5.930 | 75.027 |
| AB200-R1H32-R2Vk43 | DIQMTQSPSSLSASVGDRVTITCRASQSISSYINWYQQKPGKAPKLLIYATSNIQSGVPSRFSG SGSGTDFTLTISSLQPEDFATYYCQQFRKIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 327) | 1.295 | 9.196 | 78.820 |
| AB200-R1H32-R2Vk44 | DIQMTQSPSSLSASVGDRVTITCRASQSISSYINWYQQKPGKAPKLLIYATSNLQIGVPSRFSG SGSGTDFTLTISSLQPEDFATYYCQQYRRLPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 328) | 0.710 | 3.322 | 76.359 |
| AB200-R1H32-R2Vk45 | DIQMTQSPSSLSASVGDRVTITCRASQSISSYINWYQQKPGKAPKLLIYATSNLQIGVPSRFSG SGSGTDFTLTISSLQPEDFATYYCQQYRRIPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 329) | 0.714 | 3.335 | 77.096 |
| AB200-R1H32-R2Vk46 | DIQMTQSPSSLSASVGDRVTITCRASQSISSYINWYQQKPGKAPKLLIYATSNLQIGVPSRFSG SGSGTDFTLTISSLQPEDFATYYCQQFRRLPWTFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 330) | 0.778 | 2.977 | 80.803 |
| AB200-R1H32-R2Vk47 | DIQMTQSPSSLSASVGDRVTITCRASQSISSYINWYQQKPGKAPKLLIYATSNLQIGVPSRFSG SGSGTDFTLTISSLQPEDFATYYCQQYRKIPWSFGQGTKLEIKRTVAAPSVFIFPPSDEQLKSG TASVVCLLNNFYPREAKVQWKVDNALQSGNSQESVTEQDSKDSTYSLSSTLTLSKADYEKHK VYACEVTHQGLSSPVTKSFNRGEC (SEQ ID NO: 331) | 0.766 | 3.914 | 75.976 |

TABLE 42

Heavy Chain Screening (Round 2): Fab fragment sequences

Light chain (Fab) amino acid sequence paired with listed heavy chain clones (AB200-(2Vk30)):
DIQMTQSPSSLSASVGDRVTITCRASQSISSYLNWYQQKPGKAPKLLIYATSNLQIGVPSRFSGSGS
GTDFTLTISSLQPEDFATYYCQQYRRIPWTFGQGTKLEIKRTVAAPSVFIFPPSDEQLKSGTASVVC
LLNNFYPREAKVQWKVDNALQSGNSQESVTEQDSKDSTYSLSSTLTLSKADYEKHKVYACEVTHQGL
SSPVTKSFNRGEC (SEQ ID NO: 332)

| Clone ID | Heavy chain (Fab) amino acid sequence | K$_d$ hsBCMA (nM) | K$_d$ RhBCMA (nM) | T$_m$ (° C.) |
|---|---|---|---|---|
| AB200-(2Vk30)_R2-VH-v10 | QVQLVQSGAEVKKPGSSVKVSCKASGGTYSNYWIHWVRQAPGQGLEWMGATYRSHSDTNY NQKYKSRVTITADKSTSTAYMELSSLRSEDTAVYYCARGAIYHGYDVIENWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 333) | 85.81 | 329.65 | 77.313 |
| AB200-(2Vk30)_R2-VH-v13 | QVQLVQSGAEVKKPGSSVKVSCKASGGSFSNYWIHWVRQAPGQGLEWMGGTYRSHSDTYY AQKFKSRVTITADKSTSTAYMELSSLRSEDTAVYYCARGAIFHGYDVIENWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 334) | 44.69 | 144.02 | 78.570 |
| AB200-(2Vk30)_R2-VH-v16 | QVQLVQSGAEVKKPGSSVKVSCKASGGSFSNYWIHWVRQAPGQGLEWMGGTYRSHSDTYY NQKFKSRVTITADKSTSTAYMELSSLRSEDTAVYYCARGAIFHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 335) | 74.60 | 177.60 | 78.165 |
| AB200-(2Vk30)_R2-VH-v19 | QVQLVQSGAEVKKPGSSVKVSCKASGGTFSNYWIHWVRQAPGQGLEWMGGTYRSHSTTYY NQKFKSRVTITADKSTSTAYMELSSLRSEDTAVYYCARGAIYHGFDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 336) | 14.58 | 25.36 | 82.102 |
| AB200-(2Vk30)_R2-VH-v23 | QVQLVQSGAEVKKPGSSVKVSCKASGGTFSNYWIHWVRQAPGQGLEWMGGTYRSHSDTYY NQKYKSRVTITADKSTSTAYMELSSLRSEDTAVYYCARGAIFHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 337) | 6.89 | 25.91 | 79.432 |
| AB200-(2Vk30)_R2-VH-v30 | QVQLVQSGAEVKKPGSSVKVSCKASGGTFSNYWIHWVRQAPGQGLEWMGATYRSHSDTNY AQKFKSRVTITADKSTSTAYMELSSLRSEDTAVYYCARGAIYHGYDVIENWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 338) | 50.40 | 140.75 | 77.090 |
| AB200-(2Vk30)_R2-VH-v31 | QVQLVQSGAEVKKPGSSVKVSCKASGGTFSNYWIHWVRQAPGQGLEWMGATYRSQSDTNY NQKYKSRVTITADKSTSTAYMELSSLRSEDTAVYYCARGAVYHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 339) | 12.95 | 38.35 | 79.955 |
| AB200-(2Vk30)_R2-VH-v37 | QVQLVQSGAEVKKPGSSVKVSCKASGGTFSNYWIHWVRQAPGQGLEWMGATYRSQSDTYY NQKYKSRVTITADKSTSTAYMELSSLRSEDTAVYYCARGAVYHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 340) | 0.81 | 6.05 | 81.855 |
| AB200-(2Vk30)_R2-VH-v39 | QVQLVQSGAEVKKPGSSVKVSCKASGGTFTNYWIHWVRQAPGQGLEWMGATYRIHSDTYY AEKFKSRVTITADKSTSTAYMELSSLRSEDTAVYYCARGAIFHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 341) | 3.00 | 15.36 | 78.621 |
| AB200-(2Vk30)_R2-VH-v4 | QVQLVQSGAEVKKPGSSVKVSCKASGGTFTNYWIHWVRQAPGQGLEWMGATYRSHSDTNY AQKFKSRVTITADKSTSTAYMELSSLRSEDTAVYYCARGAIYHGYDVIENWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 342) | 46.42 | 125.39 | 77.268 |
| AB200-(2Vk30)_R2-VH-v40 | QVQLVQSGAEVKKPGSSVKVSCKASGGTFTNYWIHWVRQAPGQGLEWMGATYRIHSTTYY AQKFKSRVTITADKSTSTAYMELSSLRSEDTAVYYCARGAIYHGFDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 343) | 15.52 | 32.53 | 79.807 |
| AB200-(2Vk30)_R2-VH-v43 | QVQLVQSGAEVKKPGSSVKVSCKASGGTFTNYWIHWVRQAPGQGLEWMGGTYRIHSDTYY AQKFKSRVTITADKSTSTAYMELSSLRSEDTAVYYCARGAIYHGFDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 344) | 6.82 | 25.79 | 77.757 |
| AB200-(2Vk30)_R2-VH-v45 | QVQLVQSGAEVKKPGSSVKVSCKASGGTYSNYWIHWVRQAPGQGLEWMGATYRIHSTTNY NQKFKSRVTITADKSTSTAYMELSSLRSEDTAVYYCARGAIFHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 345) | 720.35 | 3076.46 | 78.131 |

TABLE 42-continued

Heavy Chain Screening (Round 2): Fab fragment sequences

| Clone ID | Heavy chain (Fab) amino acid sequence | $K_d$ hsBCMA (nM) | $K_d$ RhBCMA (nM) | $T_m$ (° C.) |
|---|---|---|---|---|
| AB200-(2Vk30)_R2-VH-v51 | QVQLVQSGAEVKKPGSSVKVSCKASGGSFSNYWIHWVRQAPGQGLEWMGGTYRIQSDTYY NQKFKSRVTITADKSTSTAYMELSSLRSEDTAVYYCARGAIYHGYDVIENWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 346) | 20.27 | 68.94 | 79.046 |
| AB200-(2Vk30)_R2-VH-v59 | QVQLVQSGAEVKKPGSSVKVSCKASGGTFSNYWIHWVRQAPGQGLEWMGGTYRIHSDTYY AQKFKSRVTITADKSTSTAYMELSSLRSEDTAVYYCARGAIYHGYDVIENWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 347) | 37.81 | 121.28 | 77.316 |
| AB200-(2Vk30)_R2-VH-v65 | QVQLVQSGAEVKKPGSSVKVSCKASGGTFSNYWIHWVRQAPGQGLEWMGATYRIQSTTYY NQKFKSRVTITADKSTSTAYMELSSLRSEDTAVYYCARGAIYHGFDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 348) | 27.32 | 46.80 | 81.557 |
| AB200-(2Vk30)_R2-VH-v67 | QVQLVQSGAEVKKPGSSVKVSCKASGGTFSNYWIHWVRQAPGQGLEWMGATYRIHSTTYY NEKFKSRVTITADKSTSTAYMELSSLRSEDTAVYYCARGAVYHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 349) | 16.82 | 35.67 | 82.324 |
| AB200-(2Vk30)_R2-VH-v71 | QVQLVQSGAEVKKPGSSVKVSCKASGGTFSNYWIHWVRQAPGQGLEWMGATYRIHSDTNY NEKFKSRVTITADKSTSTAYMELSSLRSEDTAVYYCARGAIFHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 350) | 29.66 | 64.08 | 77.820 |
| AB200-(2Vk30)_R2-VH-v74 | QVQLVQSGAEVKKPGSSVKVSCKASGGTFSNYWIHWVRQAPGQGLEWMGATYRIHSDTYY AEKFKSRVTITADKSTSTAYMELSSLRSEDTAVYYCARGAIYHGFDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 351) | 2.17 | 9.83 | 78.953 | hsBCMA = human BCMA;
RhBCMA = Rhesus monkey BCMA

TABLE 43

Heavy Chain Screening (Round 2): Fab fragment sequences

| | |
|---|---|
| Light chain (Fab) amino acid sequence paired with listed heavy chain clones (AB200-(2Vk31)) | DIQMTQSPSSLSASVGDRVTITCRASQSISSYLNWYQQKPGKAPKLLIYATSNLQIGVPSRFSGSGS GTDFTLTISSLQPEDFATYYCQQFRRLPWTFGQGTKLEIKRTVAAPSVFIFPPSDEQLKSGTASVVC LLNNFYPREAKVQWKVDNALQSGNSQESVTEQDSKDSTYSLSSTLTLSKADYEKHKVYACEVTHQGL SSPVTKSFNRGEC (SEQ ID NO: 352) |

| Clone ID | Heavy chain (Fab) amino acid sequence | $K_d$ hsBCMA (nM) | $K_d$ RhBCMA (nM) | $T_m$ (° C.) |
|---|---|---|---|---|
| AB200-(2Vk31)_R2-VH-v12 | QVQLVQSGAEVKKPGSSVKVSCKASGGTYSNYWIHWVRQAPGQGLEWMGATYRSHSTTYY NQKYKSRVTITADKSTSTAYMELSSLRSEDTAVYYCARGAIYHGFDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 353) | 12.99 | 18.36 | 83.892 |
| AB200-(2Vk31)_R2-VH-v17 | QVQLVQSGAEVKKPGSSVKVSCKASGGSFSNYWIHWVRQAPGQGLEWMGATYRSQSDTYY AQKFKSRVTITADKSTSTAYMELSSLRSEDTAVYYCARGAIFHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 354) | 5.77 | 16.94 | 81.682 |
| AB200-(2Vk31)_R2-VH-v18 | QVQLVQSGAEVKKPGSSVKVSCKASGGSFSNYWIHWVRQAPGQGLEWMGATYRSHSDTYY AEKFKSRVTITADKSTSTAYMELSSLRSEDTAVYYCARGAVYHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 355) | 3.55 | 14.88 | 83.629 |
| AB200-(2Vk31)_R2-VH-v2 | QVQLVQSGAEVKKPGSSVKVSCKASGGTFTNYWIHWVRQAPGQGLEWMGATYRSHSTTNY NQKFKSRVTITADKSTSTAYMELSSLRSEDTAVYYCARGAVYHGYDVIDNWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 356) | 25.01 | 55.61 | 84.104 |
| AB200-(2Vk31)_R2-VH-v20 | QVQLVQSGAEVKKPGSSVKVSCKASGGTFSNYWIHWVRQAPGQGLEWMGGTYRSHSDTNY NQKFKSRVTITADKSTSTAYMELSSLRSEDTAVYYCARGAIYHGYDVIENWGQGTLVTVSSAS TKGPSVFPLAPSSKSTSGGTAALGCLVKDYFPEPVTVSWNSGALTSGVHTFPAVLQSSGLYSL SSVVTVPSSSLGTQTYICNVNHKPSNTKVDKKVEPKSC (SEQ ID NO: 357) | 42.04 | 93.83 | 81.245 |

TABLE 43-continued

Heavy Chain Screening (Round 2): Fab fragment sequences

| | | | | |
|---|---|---|---|---|
| AB200-<br>(2Vk31)_R2-<br>VH-v21 | QVQLVQSGAEVKKPGSSVKVSCKASGGTFSNYWIHWVRQAPGQGLEWMGGTYRSHSDTYY<br>AQKFKSRVTITADKSTSTAYMELSSLRSEDTAVYYCARGAIFHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 358) | 10.74 | 29.66 | 81.367 |
| AB200-<br>(2Vk31)_R2-<br>VH-v25 | QVQLVQSGAEVKKPGSSVKVSCKASGGTFSNYWIHWVRQAPGQGLEWMGATYRSHSTTNY<br>NQKFKSRVTITADKSTSTAYMELSSLRSEDTAVYYCARGAIYHGFDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 359) | 32.80 | 57.27 | 83.328 |
| AB200-<br>(2Vk31)_R2-<br>VH-v27 | QVQLVQSGAEVKKPGSSVKVSCKASGGTFSNYWIHWVRQAPGQGLEWMGATYRSQSTTYY<br>NQKFKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 360) | 7.13 | 15.28 | 86.016 |
| AB200-<br>(2Vk31)_R2-<br>VH-v29 | QVQLVQSGAEVKKPGSSVKVSCKASGGTFSNYWIHWVRQAPGQGLEWMGATYRSHSTTYY<br>NEKFKSRVTITADKSTSTAYMELSSLRSEDTAVYYCARGAIYHGFDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 361) | 6.02 | 9.34 | 85.764 |
| AB200-<br>(2Vk31)_R2-<br>VH-v3 | QVQLVQSGAEVKKPGSSVKVSCKASGGTFTNYWIHWVRQAPGQGLEWMGGTYRSHSTTYY<br>NQKFKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 362) | 2.55 | 5.73 | 85.949 |
| AB200-<br>(2Vk31)_R2-<br>VH-v33 | QVQLVQSGAEVKKPGSSVKVSCKASGGTFSNYWIHWVRQAPGQGLEWMGATYRSHSDTNY<br>NEKFKSRVTITADKSTSTAYMELSSLRSEDTAVYYCARGAIYHGYDVIENWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 363) | 46.02 | 50.37 | 81.852 |
| AB200-<br>(2Vk31)_R2-<br>VH-v34 | QVQLVQSGAEVKKPGSSVKVSCKASGGTFSNYWIHWVRQAPGQGLEWMGATYRSQSDTYY<br>AQKFKSRVTITADKSTSTAYMELSSLRSEDTAVYYCARGAIYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 364) | 5.13 | 18.00 | 81.638 |
| AB200-<br>(2Vk31)_R2-<br>VH-v42 | QVQLVQSGAEVKKPGSSVKVSCKASGGTFTNYWIHWVRQAPGQGLEWMGGTYRIHSDTYY<br>NQKYKSRVTITADKSTSTAYMELSSLRSEDTAVYYCARGAIYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 365) | 4.33 | 23.48 | 81.487 |
| AB200-<br>(2Vk31)_R2-<br>VH-v47 | QVQLVQSGAEVKKPGSSVKVSCKASGGTYSNYWIHWVRQAPGQGLEWMGATYRIHSTTYY<br>NEKFKSRVTITADKSTSTAYMELSSLRSEDTAVYYCARGAIFHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 366) | 17.70 | 15.91 | 82.826 |
| AB200-<br>(2Vk31)_R2-<br>VH-v5 | QVQLVQSGAEVKKPGSSVKVSCKASGGTFTNYWIHWVRQAPGQGLEWMGGTYRSHSDTYY<br>NEKFKSRVTITADKSTSTAYMELSSLRSEDTAVYYCARGAIYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 367) | 3.65 | 10.42 | 83.838 |
| AB200-<br>(2Vk31)_R2-<br>VH-v50 | QVQLVQSGAEVKKPGSSVKVSCKASGGTYSNYWIHWVRQAPGQGLEWMGGTYRIHSDTNY<br>NQKFKSRVTITADKSTSTAYMELSSLRSEDTAVYYCARGAIYHGYDVIENWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 368) | 90.02 | 195.63 | 79.146 |
| AB200-<br>(2Vk31)_R2-<br>VH-v57 | QVQLVQSGAEVKKPGSSVKVSCKASGGTFSNYWIHWVRQAPGQGLEWMGGTYRIHSTTYY<br>NQKFKSRVTITADESTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 369) | 11.87 | 20.82 | 85.597 |
| AB200-<br>(2Vk31)_R2-<br>VH-v66 | QVQLVQSGAEVKKPGSSVKVSCKASGGTFSNYWIHWVRQAPGQGLEWMGATYRIHSTTYY<br>NQKYKSRVTITADKSTSTAYMELSSLRSEDTAVYYCARGAIFHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 370) | 13.74 | 20.80 | 82.876 |
| AB200-<br>(2Vk31)_R2-<br>VH-v73 | QVQLVQSGAEVKKPGSSVKVSCKASGGTFSNYWIHWVRQAPGQGLEWMGATYRIHSDTYY<br>AQKYKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 371) | 1.32 | 7.72 | 81.181 |
| AB200-<br>(2Vk31)_R2-<br>CDR1-hs-v3 | QVQLVQSGAEVKKPGSSVKVSCKASGGTFSSYAISWVRQAPGQGLEWMGATYRSQSDTYY<br>NQKYKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 372) | 319.28 | 540.37 | 78.565 |

TABLE 43-continued

Heavy Chain Screening (Round 2): Fab fragment sequences

| Clone ID | Sequence | $K_d$ hsBCMA (nM) | $K_d$ RhBCMA (nM) | $T_m$ (° C.) |
|---|---|---|---|---|
| AB200-(2Vk31)_R2-CDR2-hs-v1 | QVQLVQSGAEVKKPGSSVKVSCKASGGTFTNYWIHWVRQAPGQGLEWMGGIIPIFGTANYAQKFQGRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 373) | 240.90 | 448.44 | 85.076 |
| AB200-(2Vk31)_R2-CDR2-hs-v3 | QVQLVQSGAEVKKPGSSVKVSCKASGGTFTNYWIHWVRQAPGQGLEWMGGIIPIFGTANYAQKFQGRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 374) | 126.44 | 215.56 | 85.503 |
| AB200-(2Vk31)_R2-CDR3-hs-v1 | QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 375) | ND | ND | 80.084 |
| AB200-(2Vk31)_R2-CDR3-hs-v2 | QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 376) | ND | ND | 80.752 |
| AB200-(2Vk31)_R2-CDR3-hs-v4 | QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 377) | ND | ND | 80.378 |

ND = no data;
hsBCMA = human BCMA;
RhBCMA = Rhesus monkey BCMA

TABLE 44

Heavy Chain Screening (Round 2): Fab fragment sequences

| | |
|---|---|
| Light chain (Fab) amino acid sequence paired with listed heavy chain clones (AB200-(2Vk8)) | DIQMTQSPSSLSASVGDRVTITCRASQSISSYINWYQQKPGKAPKLLIYATSNLQIGVPSRFSGSGSGTDFTLTISSLQPEDFATYYCQQFRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 378) |

| Clone ID | Heavy chain (Fab) amino acid sequence | $K_d$ hsBCMA (nM) | $K_d$ RhBCMA (nM) | $T_m$ (° C.) |
|---|---|---|---|---|
| AB200-(2Vk8)_R2-CDR1-hs-v1 | QVQLVQSGAEVKKPGSSVKVSCKASGGTFSSYAISWVRQAPGQGLEWMGATYRSQSDTYYNQKYKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 379) | ND | ND | 75.408 |
| AB200-(2Vk8)_R2-CDR1-hs-v2 | QVQLVQSGAEVKKPGSSVKVSCKASGGTFSSYAISWVRQAPGQGLEWMGATYRSQSDTFYNQKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 380) | ND | ND | 75.669 |
| AB200-(2Vk8)_R2-CDR1-hs-v4 | QVQLVQSGAEVKKPGSSVKVSCKASGGTFSSYAISWVRQAPGQGLEWMGATYRSQSDTFYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 381) | 591.47 | 773.13 | 76.495 |
| AB200-(2Vk8)_R2-CDR2-hs-v2 | QVQLVQSGAEVKKPGSSVKVSCKASGGSFSNYWIHWVRQAPGQGLEWMGGIIPIFGTANYAQKFQGRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 382) | 151.14 | ND | 85.175 |
| AB200-(2Vk8)_R2-CDR2-hs-v4 | QVQLVQSGAEVKKPGSSVKVSCKASGGSFSNYWIHWVRQAPGQGLEWMGGIIPIFGTANYAQKFQGRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC (SEQ ID NO: 383) | ND | ND | 84.950 |

TABLE 44-continued

Heavy Chain Screening (Round 2): Fab fragment sequences

| | | | | |
|---|---|---|---|---|
| AB200-<br>(2Vk8)_R2-<br>CDR3-hs-v3 | QVQLVQSGAEVKKPGSSVKVSCKASGGTFSSYAISWVRQAPGQGLEWMGGIIPIFGTANY<br>AQKFQGRVTITADKSTSTAYMELSSLRSEDTAVYYCARGAIYHGYDVIENWGQTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 384) | ND | ND | 78.450 |

ND = no data;
hsBCMA = human BCMA;
RhBCMA = Rhesus monkey BCMA

TABLE 45

Heavy Chain Screening (Round 2): Fab fragment sequences

| | |
|---|---|
| Light chain (Fab) amino acid sequence paired with listed heavy chain clones (AB200-(2Vk35)) | DIQMTQSPSSLSASVGDRVTITCRASQSISSYINWYQQKPGKAPKLLIYATSNLQSGVPSRFSGSGS<br>GTDFTLTISSLQPEDFATYYCQQYRRIPWTFGQGTKLEIKRTVAAPSVFIFPPSDEQLKSGTASVVC<br>LLNNFYPREAKVQWKVDNALQSGNSQESVTEQDSKDSTYSLSSTLTLSKADYEKHKVYACEVTHQGL<br>SSPVTKSFNRGEC (SEQ ID NO: 385) |

| Clone ID | Heavy chain (Fab) amino acid sequence | $K_d$ hsBCMA (nM) | $K_d$ RhBCMA (nM) | $T_m$ (° C.) |
|---|---|---|---|---|
| AB200-<br>(2Vk35)_R2-<br>VH-v11 | QVQLVQSGAEVKKPGSSVKVSCKASGGTYSNYWIHWVRQAPGQGLEWMGATYRSHSDTNY<br>NEKFKSRVTITADKSTSTAYMELSSLRSEDTAVYYCARGAVYHGYDVIDNWGQTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 386) | 46.99 | 129.98 | 77.406 |
| AB200-<br>(2Vk35)_R2-<br>VH-v15 | QVQLVQSGAEVKKPGSSVKVSCKASGGSFSNYWIHWVRQAPGQGLEWMGATYRSQSTTYY<br>NQKFKSRVTITADKSTSTAYMELSSLRSEDTAVYYCARGAIFHGYDVIDNWGQTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 387) | 25.52 | 48.60 | 80.901 |
| AB200-<br>(2Vk35)_R2-<br>VH-v26 | QVQLVQSGAEVKKPGSSVKVSCKASGGTFSNYWIHWVRQAPGQGLEWMGATYRSHSTTYY<br>AQKFKSRVTITADKSTSTAYMELSSLRSEDTAVYYCARGAIFHGYDVIDNWGQTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 388) | 20.95 | 40.69 | 78.816 |
| AB200-<br>(2Vk35)_R2-<br>VH-v32 | QVQLVQSGAEVKKPGSSVKVSCKASGGTFSNYWIHWVRQAPGQGLEWMGATYRSHSDTNY<br>NQKYKSRVTITADKSTSTAYMELSSLRSEDTAVYYCARGAIFHGYDVIDNWGQTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 389) | 29.06 | 67.26 | 77.066 |
| AB200-<br>(2Vk35)_R2-<br>VH-v36 | QVQLVQSGAEVKKPGSSVKVSCKASGGTFSNYWIHWVRQAPGQGLEWMGATYRSHSDTYY<br>AEKFKSRVTITADKSTSTAYMELSSLRSEDTAVYYCARGAIFHGYDVIDNWGQTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 390) | 3.15 | 14.82 | 78.599 |
| AB200-<br>(2Vk35)_R2-<br>VH-v38 | QVQLVQSGAEVKKPGSSVKVSCKASGGTFSNYWIHWVRQAPGQGLEWMGATYRSQSDTYY<br>NEKFKSRVTITADKSTSTAYMELSSLRSEDTAVYYCARGAIYHGFDVIDNWGQTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 391) | 1.89 | 9.59 | 81.457 |
| AB200-<br>(2Vk35)_R2-<br>VH-v46 | QVQLVQSGAEVKKPGSSVKVSCKASGGTYSNYWIHWVRQAPGQGLEWMGATYRIQSDTNY<br>NQKFKSRVTITADKSTSTAYMELSSLRSEDTAVYYCARGAIYHGYDVIENWGQTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 392) | 102.71 | 287.03 | 76.222 |
| AB200-<br>(2Vk35)_R2-<br>VH-v48 | QVQLVQSGAEVKKPGSSVKVSCKASGGTYSNYWIHWVRQAPGQGLEWMGGTYRIHSTTYY<br>NQKFKSRVTITADKSTSTAYMELSSLRSEDTAVYYCARGAIYHGYDVIENWGQTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 393) | 36.62 | 51.98 | 78.848 |
| AB200-<br>(2Vk35)_R2-<br>VH-v49 | QVQLVQSGAEVKKPGSSVKVSCKASGGTYSNYWIHWVRQAPGQGLEWMGATYRIQSTTYY<br>NQKFKSRVTITADKSTSTAYMELSSLRSEDTAVYYCARGAIYHGYDVIENWGQTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 394) | 63.22 | 126.40 | 79.187 |
| AB200-<br>(2Vk35)_R2-<br>VH-v52 | QVQLVQSGAEVKKPGSSVKVSCKASGGSFSNYWIHWVRQAPGQGLEWMGATYRIQSDTYY<br>AQKFKSRVTITADKSTSTAYMELSSLRSEDTAVYYCARGAIFHGYDVIDNWGQTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 395) | 6.24 | 25.69 | 76.770 |

TABLE 45-continued

Heavy Chain Screening (Round 2): Fab fragment sequences

| | | | | |
|---|---|---|---|---|
| AB200-(2Vk35)_R2-VH-v55 | QVQLVQSGAEVKKPGSSVKVSCKASGGSFSNYWIHWVRQAPGQGLEWMGATYRIHSTTYY<br>NQKYKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 396) | 19.74 | 43.13 | 80.450 |
| AB200-(2Vk35)_R2-VH-v56 | QVQLVQSGAEVKKPGSSVKVSCKASGGSFSNYWIHWVRQAPGQGLEWMGATYRIHSDTYY<br>AQKYKSRVTITADKSTSTAYMELSSLRSEDTAVYYCARGAIFHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 397) | 11.35 | 44.71 | 77.030 |
| AB200-(2Vk35)_R2-VH-v6 | QVQLVQSGAEVKKPGSSVKVSCKASGGTFTNYWIHWVRQAPGQGLEWMGATYRSHSDTYY<br>AQKYKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 398) | 1.29 | 9.36 | 77.987 |
| AB200-(2Vk35)_R2-VH-v62 | QVQLVQSGAEVKKPGSSVKVSCKASGGTFSNYWIHWVRQAPGQGLEWMGGTYRIHSDTYY<br>NEKFKSRVTITADKSTSTAYMELSSLRSEDTAVYYCARGAIYHGYDVIENWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 399) | 14.54 | 48.96 | 78.430 |
| AB200-(2Vk35)_R2-VH-v63 | QVQLVQSGAEVKKPGSSVKVSCKASGGTFSNYWIHWVRQAPGQGLEWMGATYRIHSTTNY<br>NQKFKSRVTITADESTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 400) | 27.08 | 9.56 | 80.226 |
| AB200-(2Vk35)_R2-VH-v69 | QVQLVQSGAEVKKPGSSVKVSCKASGGTFSNYWIHWVRQAPGQGLEWMGATYRIQSDTNY<br>NQKFKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 401) | 16.22 | 46.58 | 77.807 |
| AB200-(2Vk35)_R2-VH-v76 | QVQLVQSGAEVKKPGSSVKVSCKASGGTFSNYWIHWVRQAPGQGLEWMGATYRIQSDTYY<br>NEKFKSRVTITADKSTSTAYMELSSLRSEDTAVYYCARGAIYHGFDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 402) | 1.93 | 8.46 | 79.284 |
| AB200-(2Vk35)_R2-VH-v8 | QVQLVQSGAEVKKPGSSVKVSCKASGGTYSNYWIHWVRQAPGQGLEWMGGTYRSQSDTYY<br>NQKFKSRVTITADKSTSTAYMELSSLRSEDTAVYYCARGAIYHGFDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 403) | 12.07 | 37.98 | 78.223 |
| AB200-(2Vk35)_R2-VH-v9 | QVQLVQSGAEVKKPGSSVKVSCKASGGTYSNYWIHWVRQAPGQGLEWMGATYRSQSDTNY<br>NQKFKSRVTITADKSTSTAYMELSSLRSEDTAVYYCARGAIYHGFDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 404) | 49.32 | 102.63 | 76.997 | hsBCMA = human BCMA;
RhBCMA = Rhesus monkey BCMA

TABLE 46

Heavy Chain Screening (Round 2): Fab fragment sequences

| | |
|---|---|
| Light chain (Fab) amino acid sequence paired with listed heavy chain clones (AB200-(2Vk44)) | DIQMTQSPSSLSASVGDRVTITCRASQSISSYINWYQQKPGKAPKLLIYATSNLQIGVPSRFSGSGS<br>GTDFTLTISSLQPEDFATYYCQQYRRLPWSFGQGTKLEIKRTVAAPSVFIFPPSDEQLKSGTASVVC<br>LLNNFYPREAKVQWKVDNALQSGNSQESVTEQDSKDSTYSLSSTLTLSKADYEKHKVYACEVTHQGL<br>SSPVTKSFNRGEC (SEQ ID NO: 405) |

| Clone ID | Heavy chain (Fab) amino acid sequence | K$_d$ hsBCMA (nM) | K$_d$ RhBCMA (nM) | T$_m$ (° C.) |
|---|---|---|---|---|
| AB200-(2Vk44)_R2-VH-v1 | QVQLVQSGAEVKKPGSSVKVSCKASGGTFTNYWIHWVRQAPGQGLEWMGGTYRSHSDTYY<br>NQKYKSRVTITADKSTSTAYMELSSLRSEDTAVYYCARGAIYHGYDVIENWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 406) | 11.79 | 40.05 | 78.407 |
| AB200-(2Vk44)_R2-VH-v14 | QVQLVQSGAEVKKPGSSVKVSCKASGGSFSNYWIHWVRQAPGQGLEWMGATYRSHSTTYY<br>NEKFKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 407) | 7.55 | 16.86 | 81.915 |

TABLE 46-continued

Heavy Chain Screening (Round 2): Fab fragment sequences

| | | | | |
|---|---|---|---|---|
| AB200-<br>(2Vk44)_R2-<br>VH-v22 | QVQLVQSGAEVKKPGSSVKVSCKASGGTFSNYWIHWVRQAPGQGLEWMGGTYRSQSDTYY<br>NQKFKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 408) | 2.31 | 11.09 | 79.696 |
| AB200-<br>(2Vk44)_R2-<br>VH-v24 | QVQLVQSGAEVKKPGSSVKVSCKASGGTFSNYWIHWVRQAPGQGLEWMGGTYRSHSDTYY<br>NEKFKSRVTITADKSTSTAYMELSSLRSEDTAVYYCARGAIFHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 409) | 6.44 | 20.82 | 79.156 |
| AB200-<br>(2Vk44)_R2-<br>VH-v28 | QVQLVQSGAEVKKPGSSVKVSCKASGGTFSNYWIHWVRQAPGQGLEWMGATYRSHSTTYY<br>NQKYKSRVTITADKSTSTAYMELSSLRSEDTAVYYCARGAIYHGFDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 410) | 10.93 | 20.88 | 80.311 |
| AB200-<br>(2Vk44)_R2-<br>VH-v35 | QVQLVQSGAEVKKPGSSVKVSCKASGGTFSNYWIHWVRQAPGQGLEWMGATYRSHSDTYY<br>AQKYKSRVTITADKSTSTAYMELSSLRSEDTAVYYCARGAIYHGYDVIENWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 411) | 16.23 | 52.82 | 76.189 |
| AB200-<br>(2Vk44)_R2-<br>VH-v41 | QVQLVQSGAEVKKPGSSVKVSCKASGGTFTNYWIHWVRQAPGQGLEWMGGTYRIHSDTYY<br>NEKFKSRVTITADKSTSTAYMELSSLRSEDTAVYYCARGAIYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 412) | 3.73 | 12.59 | 78.286 |
| AB200-<br>(2Vk44)_R2-<br>VH-v44 | QVQLVQSGAEVKKPGSSVKVSCKASGGTFTNYWIHWVRQAPGQGLEWMGATYRIHSDTNY<br>AQKFKSRVTITADKSTSTAYMELSSLRSEDTAVYYCARGAIYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 413) | 86.40 | 289.55 | 74.070 |
| AB200-<br>(2Vk44)_R2-<br>VH-v53 | QVQLVQSGAEVKKPGSSVKVSCKASGGSFSNYWIHWVRQAPGQGLEWMGATYRIHSDTNY<br>NQKYKSRVTITADKSTSTAYMELSSLRSEDTAVYYCARGAIFHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 414) | 52.45 | 103.16 | 75.218 |
| AB200-<br>(2Vk44)_R2-<br>VH-v54 | QVQLVQSGAEVKKPGSSVKVSCKASGGSFSNYWIHWVRQAPGQGLEWMGATYRIHSDTNY<br>NEKFKSRVTITADKSTSTAYMELSSLRSEDTAVYYCARGAIYHGYDVIENWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 415) | 68.85 | 150.52 | 75.912 |
| AB200-<br>(2Vk44)_R2-<br>VH-v58 | QVQLVQSGAEVKKPGSSVKVSCKASGGTFSNYWIHWVRQAPGQGLEWMGGTYRIHSDTNY<br>NQKFKSRVTITADKSTSTAYMELSSLRSEDTAVYYCARGAIYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 416) | 27.20 | 52.61 | 75.513 |
| AB200-<br>(2Vk44)_R2-<br>VH-v60 | QVQLVQSGAEVKKPGSSVKVSCKASGGTFSNYWIHWVRQAPGQGLEWMGGTYRIQSDTYY<br>NQKFKSRVTITADKSTSTAYMELSSLRSEDTAVYYCARGAIYHGYDVIENWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 417) | 11.09 | 38.57 | 77.692 |
| AB200-<br>(2Vk44)_R2-<br>VH-v61 | QVQLVQSGAEVKKPGSSVKVSCKASGGTFSNYWIHWVRQAPGQGLEWMGGTYRIHSDTYY<br>NQKFKSRVTITADKSTSTAYMELSSLRSEDTAVYYCARGAIYHGYDVIENWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 418) | 19.20 | 59.60 | 76.850 |
| AB200-<br>(2Vk44)_R2-<br>VH-v64 | QVQLVQSGAEVKKPGSSVKVSCKASGGTFSNYWIHWVRQAPGQGLEWMGATYRIHSTTYY<br>AQKFKSRVTITADKSTSTAYMELSSLRSEDTAVYYCARGAIYHGFDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 419) | 22.07 | 36.52 | 77.787 |
| AB200-<br>(2Vk44)_R2-<br>VH-v68 | QVQLVQSGAEVKKPGSSVKVSCKASGGTFSNYWIHWVRQAPGQGLEWMGATYRIHSDTNY<br>AQKFKSRVTITADESTSTAYMELSSLRSEDTAVYYCARGAIYHGFDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 420) | 60.30 | 109.51 | 75.716 |
| AB200-<br>(2Vk44)_R2-<br>VH-v7 | QVQLVQSGAEVKKPGSSVKVSCKASGGTYSNYWIHWVRQAPGQGLEWMGATYRSHSTTYY<br>AQKFKSRVTITADKSTSTAYMELSSLRSEDTAVYYCARGAIYHGFDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 421) | 40.65 | 71.65 | 77.428 |
| AB200-<br>(2Vk44)_R2-<br>VH-v70 | QVQLVQSGAEVKKPGSSVKVSCKASGGTFSNYWIHWVRQAPGQGLEWMGATYRIHSDTNY<br>NQKYKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 422) | 12.37 | 35.80 | 76.335 |

TABLE 46-continued

Heavy Chain Screening (Round 2): Fab fragment sequences

| | | | | |
|---|---|---|---|---|
| AB200-<br>(2Vk44)_R2-<br>VH-v72 | QVQLVQSGAEVKKPGSSVKVSCKASGGTFSNYWIHWVRQAPGQGLEWMGATYRIQSDTYY<br>AQKFKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 423) | 2.16 | 12.43 | 77.278 |
| AB200-<br>(2Vk44)_R2-<br>VH-v75 | QVQLVQSGAEVKKPGSSVKVSCKASGGTFSNYWIHWVRQAPGQGLEWMGATYRIQSDTYY<br>NQKYKSRVTITADKSTSTAYMELSSLRSEDTAVYYCARGAVYHGYDVIDNWGQGTLVTVSSAS<br>TKGPSVFPLAPSSKSTSGGTAALGCLVKDYFPEPVTVSWNSGALTSGVHTFPAVLQSSGLYSL<br>SSVVTVPSSSLGTQTYICNVNHKPSNTKVDKKVEPKSC (SEQ ID NO: 424) | 0.80 | 5.22 | 78.398 | hsBCMA = human BCMA;
RhBCMA = Rhesus monkey BCMA

SEQUENCE LISTING (424 sequences)

SEQ ID NO: 1 - protein, 5 aa, Artificial Sequence
  Description of Artificial Sequence: Synthetic peptide
NYWIH

SEQ ID NO: 2 - protein, 17 aa, Artificial Sequence
  Description of Artificial Sequence: Synthetic peptide
GTYRSHSDTNYNQKFKS

SEQ ID NO: 3 - protein, 12 aa, Artificial Sequence
  Description of Artificial Sequence: Synthetic peptide
GAIYHGYDVIEN

SEQ ID NO: 4 - protein, 11 aa, Artificial Sequence
  Description of Artificial Sequence: Synthetic peptide
RASQSISSYLN

SEQ ID NO: 5 - protein, 7 aa, Artificial Sequence
  Description of Artificial Sequence: Synthetic peptide
ATSNLQI

SEQ ID NO: 6 - protein, 9 aa, Artificial Sequence
  Description of Artificial Sequence: Synthetic peptide
QQFRRLPWT

SEQ ID NO: 7 - protein, 17 aa, Artificial Sequence
  Description of Artificial Sequence: Synthetic peptide
GTYRSHSTTYYNQKFKS

SEQ ID NO: 8 - protein, 12 aa, Artificial Sequence
  Description of Artificial Sequence: Synthetic peptide
GAVYHGYDVIDN

SEQ ID NO: 9 - protein, 11 aa, Artificial Sequence
  Description of Artificial Sequence: Synthetic peptide
RASQSISSYLN

SEQ ID NO: 10 - protein, 7 aa, Artificial Sequence
  Description of Artificial Sequence: Synthetic peptide
ATSNLQI

SEQ ID NO: 11 - protein, 9 aa, Artificial Sequence
  Description of Artificial Sequence: Synthetic peptide
QQFRRLPWT

SEQ ID NO: 12 - protein, 17 aa, Artificial Sequence
  Description of Artificial Sequence: Synthetic peptide
ATYRSQSDTYYNQKYKS

SEQ ID NO: 13 - protein, 12 aa, Artificial Sequence
  Description of Artificial Sequence: Synthetic peptide
GAVYHGYDVIDN

SEQ ID NO: 14 - protein, 11 aa, Artificial Sequence
  Description of Artificial Sequence: Synthetic peptide
RASQSISSYLN

SEQ ID NO: 15 - protein, 7 aa, Artificial Sequence
  Description of Artificial Sequence: Synthetic peptide
ATSNLQI

SEQ ID NO: 16 - protein, 9 aa, Artificial Sequence
  Description of Artificial Sequence: Synthetic peptide
QQYRRIPWT

SEQ ID NO: 17 - protein, 17 aa, Artificial Sequence
  Description of Artificial Sequence: Synthetic peptide
GTYRSHSTTYYNQKFKS

SEQ ID NO: 18 - protein, 12 aa, Artificial Sequence
  Description of Artificial Sequence: Synthetic peptide
GAVYHGYDVIDN

SEQ ID NO: 19 - protein, 11 aa, Artificial Sequence
  Description of Artificial Sequence: Synthetic peptide
RASQSISSYLN

SEQ ID NO: 20 - protein, 7 aa, Artificial Sequence
  Description of Artificial Sequence: Synthetic peptide
ATSNLQI

SEQ ID NO: 21 - protein, 9 aa, Artificial Sequence
  Description of Artificial Sequence: Synthetic peptide
QQYRRIPWT

SEQ ID NO: 22 - protein, 17 aa, Artificial Sequence
  Description of Artificial Sequence: Synthetic peptide
ATYRIQSDTYYNQKYKS

SEQ ID NO: 23 - protein, 12 aa, Artificial Sequence
  Description of Artificial Sequence: Synthetic peptide
GAVYHGYDVIDN

SEQ ID NO: 24 - protein, 11 aa, Artificial Sequence
  Description of Artificial Sequence: Synthetic peptide
RASQSISSYIN

SEQ ID NO: 25 - protein, 7 aa, Artificial Sequence
  Description of Artificial Sequence: Synthetic peptide
ATSNLQI

SEQ ID NO: 26 - protein, 9 aa, Artificial Sequence
  Description of Artificial Sequence: Synthetic peptide
QQYRRLPWS

SEQ ID NO: 27 - protein, 17 aa, Artificial Sequence
  Description of Artificial Sequence: Synthetic peptide
ATYRSHSDTYYAQKYKS

SEQ ID NO: 28 - protein, 12 aa, Artificial Sequence
  Description of Artificial Sequence: Synthetic peptide
GAVYHGYDVIDN

SEQ ID NO: 29 - protein, 11 aa, Artificial Sequence
  Description of Artificial Sequence: Synthetic peptide
RASQSISSYIN

SEQ ID NO: 30 - protein, 7 aa, Artificial Sequence
  Description of Artificial Sequence: Synthetic peptide
ATSNLQS

SEQ ID NO: 31 - protein, 9 aa, Artificial Sequence
  Description of Artificial Sequence: Synthetic peptide
QQYRRIPWT

SEQ ID NO: 32 - protein, 17 aa, Artificial Sequence
  Description of Artificial Sequence: Synthetic peptide
ATYRSQSTTYYNQKFKS

SEQ ID NO: 33 - protein, 12 aa, Artificial Sequence
  Description of Artificial Sequence: Synthetic peptide
GAVYHGYDVIDN

SEQ ID NO: 34 - protein, 11 aa, Artificial Sequence
  Description of Artificial Sequence: Synthetic peptide
RASQSISSYLN

SEQ ID NO: 35 - protein, 7 aa, Artificial Sequence
  Description of Artificial Sequence: Synthetic peptide
ATSNLQI

SEQ ID NO: 36 - protein, 9 aa, Artificial Sequence
  Description of Artificial Sequence: Synthetic peptide
QQFRRLPWT

SEQ ID NO: 37 - protein, 8 aa, Artificial Sequence
  Description of Artificial Sequence: Synthetic peptide
GGTFSNYW

SEQ ID NO: 38 - protein, 8 aa, Artificial Sequence
  Description of Artificial Sequence: Synthetic peptide
TYRSHSDT

SEQ ID NO: 39 - protein, 14 aa, Artificial Sequence
  Description of Artificial Sequence: Synthetic peptide
ARGAIYHGYDVIEN

SEQ ID NO: 40 - protein, 6 aa, Artificial Sequence
  Description of Artificial Sequence: Synthetic peptide
QSISSY

SEQ ID NO: 41 - protein, 3 aa, Artificial Sequence
  Description of Artificial Sequence: Synthetic peptide
ATS

SEQ ID NO: 42 - protein, 9 aa, Artificial Sequence
  Description of Artificial Sequence: Synthetic peptide
QQFRRLPWT

SEQ ID NO: 43 - protein, 8 aa, Artificial Sequence
  Description of Artificial Sequence: Synthetic peptide
GGTFTNYW

SEQ ID NO: 44 - protein, 8 aa, Artificial Sequence
  Description of Artificial Sequence: Synthetic peptide
TYRSHSTT

SEQ ID NO: 45 - protein, 14 aa, Artificial Sequence
  Description of Artificial Sequence: Synthetic peptide
ARGAVYHGYDVIDN

SEQ ID NO: 46 - protein, 9 aa, Artificial Sequence
  Description of Artificial Sequence: Synthetic peptide
QQFRRLPWT

SEQ ID NO: 47 - protein, 8 aa, Artificial Sequence
  Description of Artificial Sequence: Synthetic peptide
GGTFSNYW

SEQ ID NO: 48 - protein, 8 aa, Artificial Sequence
  Description of Artificial Sequence: Synthetic peptide
TYRSQSDT

SEQ ID NO: 49 - protein, 14 aa, Artificial Sequence
  Description of Artificial Sequence: Synthetic peptide
ARGAVYHGYDVIDN

SEQ ID NO: 50 - protein, 9 aa, Artificial Sequence
  Description of Artificial Sequence: Synthetic peptide
QQYRRIPWT

SEQ ID NO: 51 - protein, 8 aa, Artificial Sequence
  Description of Artificial Sequence: Synthetic peptide
GGTFTNYW

SEQ ID NO: 52 - protein, 8 aa, Artificial Sequence
  Description of Artificial Sequence: Synthetic peptide
TYRSHSTT

SEQ ID NO: 53 - protein, 14 aa, Artificial Sequence
  Description of Artificial Sequence: Synthetic peptide
ARGAVYHGYDVIDN

SEQ ID NO: 54 - protein, 9 aa, Artificial Sequence
  Description of Artificial Sequence: Synthetic peptide
QQYRRIPWT

SEQ ID NO: 55 - protein, 8 aa, Artificial Sequence
  Description of Artificial Sequence: Synthetic peptide
GGTFSNYW

SEQ ID NO: 56 - protein, 8 aa, Artificial Sequence
  Description of Artificial Sequence: Synthetic peptide
TYRIQSDT

SEQ ID NO: 57 - protein, 14 aa, Artificial Sequence
  Description of Artificial Sequence: Synthetic peptide
ARGAVYHGYDVIDN

SEQ ID NO: 58 - protein, 9 aa, Artificial Sequence
  Description of Artificial Sequence: Synthetic peptide
QQYRRLPWS

SEQ ID NO: 59 - protein, 8 aa, Artificial Sequence
  Description of Artificial Sequence: Synthetic peptide
GGTFTNYW

SEQ ID NO: 60 - protein, 8 aa, Artificial Sequence
  Description of Artificial Sequence: Synthetic peptide
TYRSHSDT

SEQ ID NO: 61 - protein, 14 aa, Artificial Sequence
  Description of Artificial Sequence: Synthetic peptide
ARGAVYHGYDVIDN

SEQ ID NO: 62 - protein, 9 aa, Artificial Sequence
  Description of Artificial Sequence: Synthetic peptide
QQYRRIPWT

SEQ ID NO: 63 - protein, 8 aa, Artificial Sequence
  Description of Artificial Sequence: Synthetic peptide
GGTFSNYW

SEQ ID NO: 64 - protein, 8 aa, Artificial Sequence
  Description of Artificial Sequence: Synthetic peptide
TYRSQSTT

SEQ ID NO: 65 - protein, 14 aa, Artificial Sequence
  Description of Artificial Sequence: Synthetic peptide
ARGAVYHGYDVIDN

SEQ ID NO: 66 - protein, 9 aa, Artificial Sequence
  Description of Artificial Sequence: Synthetic peptide
QQFRRLPWT

SEQ ID NO: 67 - protein, 17 aa, Artificial Sequence
  Description of Artificial Sequence: Synthetic peptide
  MOD_RES (1)..(1): A or G
  MOD_RES (5)..(5): S or I
  MOD_RES (6)..(6): H or Q
  MOD_RES (8)..(8): D or T
  MOD_RES (10)..(10): Y or N
  MOD_RES (12)..(12): N or A
  MOD_RES (15)..(15): F or Y
XTYRXXSXTXYXQKXKS

SEQ ID NO: 68 - protein, 12 aa, Artificial Sequence
  Description of Artificial Sequence: Synthetic peptide
  MOD_RES (3)..(3): I or V
  MOD_RES (11)..(11): E or D
GAXYHGYDVIXN

SEQ ID NO: 69 - protein, 11 aa, Artificial Sequence
  Description of Artificial Sequence: Synthetic peptide
  MOD_RES (10)..(10): L or I
RASQSISSYXN

SEQ ID NO: 70 - protein, 7 aa, Artificial Sequence
  Description of Artificial Sequence: Synthetic peptide
  MOD_RES (7)..(7): S or I
ATSNLQX

SEQ ID NO: 71 - protein, 9 aa, Artificial Sequence
  Description of Artificial Sequence: Synthetic peptide
  MOD_RES (3)..(3): F or Y
  MOD_RES (6)..(6): L or I
  MOD_RES (9)..(9): T or S
QQXRRXPWX

SEQ ID NO: 72 - protein, 8 aa, Artificial Sequence
  Description of Artificial Sequence: Synthetic peptide
  MOD_RES (5)..(5): S or T
GGTFXNYW

SEQ ID NO: 73 - protein, 8 aa, Artificial Sequence
  Description of Artificial Sequence: Synthetic peptide
  MOD_RES (4)..(4): S or I
  MOD_RES (5)..(5): H or Q
  MOD_RES (7)..(7): D or T
TYRXXSXT

SEQ ID NO: 74 - protein, 14 aa, Artificial Sequence
  Description of Artificial Sequence: Synthetic peptide
  MOD_RES (5)..(5): I or V
  MOD_RES (13)..(13): D or E
ARGAXYHGYDVIXN

SEQ ID NO: 75 - protein, 9 aa, Artificial Sequence
  Description of Artificial Sequence: Synthetic peptide
  MOD_RES (3)..(3): Y or F
  MOD_RES (6)..(6): L or I
  MOD_RES (9)..(9): T or S
QQXRRXPWX

SEQ ID NO: 76 - protein, 121 aa, Artificial Sequence
  Description of Artificial Sequence: Synthetic polypeptide
QVQLVQSGAEVKKPGSSVKVSCKASGGTFSNYWIHWVRQAPGQGLEWMGGTYRSHSDTNYNQKFKSRVTITADKSTSTAYMELSSLRSEDTAVYYCARGAIYHGYDVIENWGQGTLVTVSS

SEQ ID NO: 77 - protein, 107 aa, Artificial Sequence
  Description of Artificial Sequence: Synthetic polypeptide
DIQMTQSPSSLSASVGDRVTITCRASQSISSYLNWYQQKPGKAPKLLIYATSNLQIGVPSRFSGSGSGTDFTLTISSLQPEDFATYYCQQFRRLPWTFGQGTKLEIK

SEQ ID NO: 78 - protein, 121 aa, Artificial Sequence
  Description of Artificial Sequence: Synthetic polypeptide
QVQLVQSGAEVKKPGSSVKVSCKASGGTFTNYWIHWVRQAPGQGLEWMGGTYRSHSTTYYNQKFKSRVTITADKSTSTAYMELSSLRSEDTAVYYCARGAVYHGYDVIDNWGQGTLVTVSS

SEQ ID NO: 79 - protein, 107 aa, Artificial Sequence; identical to SEQ ID NO: 77
  Description of Artificial Sequence: Synthetic polypeptide

SEQ ID NO: 80 - protein, 121 aa, Artificial Sequence
  Description of Artificial Sequence: Synthetic polypeptide
QVQLVQSGAEVKKPGSSVKVSCKASGGTFSNYWIHWVRQAPGQGLEWMGATYRSQSDTYYNQKYKSRVTITADKSTSTAYMELSSLRSEDTAVYYCARGAVYHGYDVIDNWGQGTLVTVSS

SEQ ID NO: 81 - protein, 107 aa, Artificial Sequence
  Description of Artificial Sequence: Synthetic polypeptide
DIQMTQSPSSLSASVGDRVTITCRASQSISSYLNWYQQKPGKAPKLLIYATSNLQIGVPSRFSGSGSGTDFTLTISSLQPEDFATYYCQQYRRIPWTFGQGTKLEIK

SEQ ID NO: 82 - protein, 121 aa, Artificial Sequence; identical to SEQ ID NO: 78
  Description of Artificial Sequence: Synthetic polypeptide

SEQ ID NO: 83 - protein, 107 aa, Artificial Sequence; identical to SEQ ID NO: 81
  Description of Artificial Sequence: Synthetic polypeptide

SEQ ID NO: 84 - protein, 121 aa, Artificial Sequence
  Description of Artificial Sequence: Synthetic polypeptide
QVQLVQSGAEVKKPGSSVKVSCKASGGTFSNYWIHWVRQAPGQGLEWMGATYRIQSDTYYNQKYKSRVTITADKSTSTAYMELSSLRSEDTAVYYCARGAVYHGYDVIDNWGQGTLVTVSS

SEQ ID NO: 85 - protein, 107 aa, Artificial Sequence
  Description of Artificial Sequence: Synthetic polypeptide
DIQMTQSPSSLSASVGDRVTITCRASQSISSYINWYQQKPGKAPKLLIYATSNLQIGVPSRFSGSGSGTDFTLTISSLQPEDFATYYCQQYRRLPWSFGQGTKLEIK

SEQ ID NO: 86 - protein, 121 aa, Artificial Sequence
  Description of Artificial Sequence: Synthetic polypeptide
QVQLVQSGAEVKKPGSSVKVSCKASGGTFTNYWIHWVRQAPGQGLEWMGATYRSHSDTYYAQKYKSRVTITADKSTSTAYMELSSLRSEDTAVYYCARGAVYHGYDVIDNWGQGTLVTVSS

SEQ ID NO: 87 - protein, 107 aa, Artificial Sequence
  Description of Artificial Sequence: Synthetic polypeptide
DIQMTQSPSSLSASVGDRVTITCRASQSISSYINWYQQKPGKAPKLLIYATSNLQSGVPSRFSGSGSGTDFTLTISSLQPEDFATYYCQQYRRIPWTFGQGTKLEIK

SEQ ID NO: 88 - protein, 121 aa, Artificial Sequence
  Description of Artificial Sequence: Synthetic polypeptide
QVQLVQSGAEVKKPGSSVKVSCKASGGTFSNYWIHWVRQAPGQGLEWMGATYRSQSTTYYNQKFKSRVTITADKSTSTAYMELSSLRSEDTAVYYCARGAVYHGYDVIDNWGQGTLVTVSS

SEQ ID NO: 89 - protein, 107 aa, Artificial Sequence; identical to SEQ ID NO: 77
  Description of Artificial Sequence: Synthetic polypeptide

SEQ ID NO: 90 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 91 - protein, 107 aa, Artificial Sequence [sequence omitted]

SEQ ID NO: 92 - protein, 450 aa, Artificial Sequence
  Description of Artificial Sequence: Synthetic polypeptide
QVQLVQSGAEVKKPGSSVKVSCKASGGTFSNYWIHWVRQAPGQGLEWMGGTYRSHSDTNYNQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 93 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQIGVPSRFSGSGSGTDFTLTISSLQPEDFATYYCQQFRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 94 - protein, 450 aa, Artificial Sequence
  Description of Artificial Sequence: Synthetic polypeptide
QVQLVQSGAEVKKPGSSVKVSCKASGGTFTNYWIHWVRQAPGQGLEWMGGTYRSHSTTYYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 95 - protein, 214 aa, Artificial Sequence; identical to SEQ ID NO: 93
  Description of Artificial Sequence: Synthetic polypeptide

SEQ ID NO: 96 - protein, 450 aa, Artificial Sequence
  Description of Artificial Sequence: Synthetic polypeptide
QVQLVQSGAEVKKPGSSVKVSCKASGGTFSNYWIHWVRQAPGQGLEWMGATYRSQSDTYYNQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 97 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQIGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 98 - protein, 450 aa, Artificial Sequence; identical to SEQ ID NO: 94
  Description of Artificial Sequence: Synthetic polypeptide

SEQ ID NO: 99 - protein, 214 aa, Artificial Sequence; identical to SEQ ID NO: 97
  Description of Artificial Sequence: Synthetic polypeptide

SEQ ID NO: 100 - protein, 450 aa, Artificial Sequence
  Description of Artificial Sequence: Synthetic polypeptide
QVQLVQSGAEVKKPGSSVKVSCKASGGTFSNYWIHWVRQAPGQGLEWMGATYRIQSDTYYNQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 101 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQIGVPSRFSGSGSGTDFTLTISSLQPEDFATYYCQQYRRLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 450 aa, Artificial Sequence
  Description of Artificial Sequence: Synthetic polypeptide
QVQLVQSGAEVKKPGSSVKVSCKASGGTFTNYWIHWVRQAPGQGLEWMGATYRSHSDTYYAQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 103 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQSGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 104 - protein, 450 aa, Artificial Sequence
  Description of Artificial Sequence: Synthetic polypeptide
QVQLVQSGAEVKKPGSSVKVSCKASGGTFSNYWIHWVRQAPGQGLEWMGATYRSQSTTYYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 105 - protein, 214 aa, Artificial Sequence; identical to SEQ ID NO: 93
  Description of Artificial Sequence: Synthetic polypeptide

SEQ ID NO: 106 - protein, 184 aa, Homo sapiens [sequence omitted]

SEQ ID NO: 107 - protein, 5 aa, Artificial Sequence
  Description of Artificial Sequence: Synthetic peptide
NYWMH

SEQ ID NO: 108 - protein, 17 aa, Artificial Sequence
  Description of Artificial Sequence: Synthetic peptide
ATYRGHSDTYYNQKFKG

SEQ ID NO: 109 - protein, 12 aa, Artificial Sequence
  Description of Artificial Sequence: Synthetic peptide
GAIYDGYDVLDN

SEQ ID NO: 110 - protein, 11 aa, Artificial Sequence
  Description of Artificial Sequence: Synthetic peptide
SASQDISNYLN

SEQ ID NO: 111 - protein, 7 aa, Artificial Sequence
  Description of Artificial Sequence: Synthetic peptide
YTSNLHS

SEQ ID NO: 112 - protein, 9 aa, Artificial Sequence
  Description of Artificial Sequence: Synthetic peptide
QQYRKLPWT

SEQ ID NO: 113 - protein, 8 aa, Artificial Sequence
  Description of Artificial Sequence: Synthetic peptide
GGTFSNYW

SEQ ID NO: 114 - protein, 8 aa, Artificial Sequence
  Description of Artificial Sequence: Synthetic peptide
TYRGHSDT

SEQ ID NO: 115 - protein, 14 aa, Artificial Sequence
  Description of Artificial Sequence: Synthetic peptide
ARGAIYDGYDVLDN

SEQ ID NO: 116 - protein, 6 aa, Artificial Sequence
  Description of Artificial Sequence: Synthetic peptide
QDISNY

SEQ ID NO: 117 - protein, 3 aa, Artificial Sequence
  Description of Artificial Sequence: Synthetic peptide
YTS

SEQ ID NO: 118 - protein, 9 aa, Artificial Sequence
  Description of Artificial Sequence: Synthetic peptide
QQYRKLPWT

SEQ ID NO: 119 - protein, 121 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSS

SEQ ID NO: 120 - protein, 107 aa, Artificial Sequence
  Description of Artificial Sequence: Synthetic polypeptide
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIK

SEQ ID NO: 121 - protein, 329 aa, Artificial Sequence; identical to SEQ ID NO: 90
  Description of Artificial Sequence: Synthetic polypeptide

SEQ ID NO: 122 - protein, 107 aa, Artificial Sequence [sequence omitted]

SEQ ID NO: 123 - protein, 450 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 124 - protein, 214 aa, Artificial Sequence
  Description of Artificial Sequence: Synthetic polypeptide
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 125 - protein, 4 aa, Artificial Sequence
  Description of Artificial Sequence: Synthetic peptide
GFGG

SEQ ID NO: 126 - protein, 4 aa, Artificial Sequence
  Description of Artificial Sequence: Synthetic peptide
GFLG

SEQ ID NO: 127 - protein, 4 aa, Artificial Sequence
  Description of Artificial Sequence: Synthetic peptide
ALAL

SEQ ID NO: 128 - DNA, 20 bp, Artificial Sequence
  Description of Artificial Sequence: Synthetic primer
actctcttccgcatcgctgt

SEQ ID NO: 129 - DNA, 20 bp, Artificial Sequence
  Description of Artificial Sequence: Synthetic primer
ccgacgggtttccgatccaa

SEQ ID NO: 130 - DNA, 18 bp, Artificial Sequence
  Description of Artificial Sequence: Synthetic probe
ctgttgggctcgcggttg

SEQ ID NO: 131 - DNA, 20 bp, Artificial Sequence
  Description of Artificial Sequence: Synthetic primer
tggcatcagattgcaaagac

SEQ ID NO: 132 - DNA, 20 bp, Artificial Sequence
  Description of Artificial Sequence: Synthetic primer
acgccgggtgatgtatctat

SEQ ID NO: 133 - DNA, 20 bp, Artificial Sequence
  Description of Artificial Sequence: Synthetic probe
cgaaacgcacccgtcagacg

SEQ ID NO: 134 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 135 - protein, 214 aa, Artificial Sequence
  Description of Artificial Sequence: Synthetic polypeptide
DIQMTQSPSSLSASVGDRVTITCRASQDISSYLNWYQQKPGKAPKLLIYYTSNIHSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 136 - protein, 214 aa, Artificial Sequence
  Description of Artificial Sequence: Synthetic polypeptide
DIQMTQSPSSLSASVGDRVTITCSASQEVSNYLNWYQQKPGKAPKLLIYYTSNLHSGVPSRFSGSGSGTDFTLTISSLQPEDFATYYCQEYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 214 aa, Artificial Sequence
  Description of Artificial Sequence: Synthetic polypeptide
DIQMTQSPSSLSASVGDRVTITCSASQDISNYINWYQQKPGKAPKLLIYYTSNMHSGVPSRFSGSGSGTDFTLTISSLQPEDFATYYCQQYRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 138 - protein, 214 aa, Artificial Sequence
  Description of Artificial Sequence: Synthetic polypeptide
DIQMTQSPSSLSASVGDRVTITCTATQDITNYLNWYQQKPGKAPKLLIYYTSNLHSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 139 - protein, 214 aa, Artificial Sequence
  Description of Artificial Sequence: Synthetic polypeptide
DIQMTQSPSSLSASVGDRVTITCSASQDISSYLNWYQQKPGKAPKLLIYYTSNLHSGVPSRFSGSGSGTDFTLTISSLQPEDFATYYCQQYRSTPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 140 - protein, 214 aa, Artificial Sequence
  Description of Artificial Sequence: Synthetic polypeptide
DIQMTQSPSSLSASVGDRVTITCSATQDISNYLNWYQQKPGKAPKLLIYFTSNLQSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 141 - protein, 214 aa, Artificial Sequence
  Description of Artificial Sequence: Synthetic polypeptide
DIQMTQSPSSLSASVGDRVTITCSASQDISNFLNWYQQKPGKAPKLLIYYTSNLHSGVPSRFSGSGSGTDFTLTISSLQPEDFATYYCQQFRKMPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - protein, 214 aa, Artificial Sequence
  Description of Artificial Sequence: Synthetic polypeptide
DIQMTQSPSSLSASVGDRVTITCSASQDISNYLNWYQQKPGKAPKLLIYYTSNLQSGVPSRFSGSGSGTDFTLTISSLQPEDFATYYCHQSRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 143 - protein, 214 aa, Artificial Sequence
  Description of Artificial Sequence: Synthetic polypeptide
DIQMTQSPSSLSASVGDRVTITCSASQEISNYLNWYQQKPGKAPKLLIYATSNLHSGVPSRFSGSGSGTDFTLTISSLQPEDFATYYCQQYRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 144 - protein, 214 aa, Artificial Sequence
  Description of Artificial Sequence: Synthetic polypeptide
DIQMTQSPSSLSASVGDRVTITCSASQSISNYLNWYQQKPGKAPKLLIYYTSNLHSGVPSRFSGSGSGTDFTLTISSLQPEDFATYYCQQSRKMPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 145 - protein, 214 aa, Artificial Sequence
  Description of Artificial Sequence: Synthetic polypeptide
DIQMTQSPSSLSASVGDRVTITCRASQDVSNYLNWYQQKPGKAPKLLIYYTTNLHSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 214 aa, Artificial Sequence
  Description of Artificial Sequence: Synthetic polypeptide
DIQMTQSPSSLSASVGDRVTITCSASQDISNYLNWYQQKPGKAPKLLIYYATNLHSGVPSRFSGSGSGTDFTLTISSLQPEDFATYYCQQYRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 147 - protein, 214 aa, Artificial Sequence
  Description of Artificial Sequence: Synthetic polypeptide
DIQMTQSPSSLSASVGDRVTITCSASNDISNYLNWYQQKPGKAPKLLIYYSSDLHSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 148 - protein, 214 aa, Artificial Sequence
  Description of Artificial Sequence: Synthetic polypeptide
DIQMTQSPSSLSASVGDRVTITCSASQDISNYLNWYQQKPGKAPKLLIYYSSNMHSGVPSRFSGSGSGTDFTLTISSLQPEDFATYYCQQFRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 149 - protein, 214 aa, Artificial Sequence
  Description of Artificial Sequence: Synthetic polypeptide
DIQMTQSPSSLSASVGDRVTITCSASHEISNYLNWYQQKPGKAPKLLIYYTSSLHSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 150 - protein, 214 aa, Artificial Sequence
  Description of Artificial Sequence: Synthetic polypeptide
DIQMTQSPSSLSASVGDRVTITCSASQDITNYLNWYQQKPGKAPKLLIYATSNLHSGVPSRFSGSGSGTDFTLTISSLQPEDFATYYCQEYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 151 - protein, 214 aa, Artificial Sequence
  Description of Artificial Sequence: Synthetic polypeptide
DIQMTQSPSSLSASVGDRVTITCSATQDISNYLNWYQQKPGKAPKLLIYYTTNLHSGVPSRFSGSGSGTDFTLTISSLQPEDFATYYCQQYYKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 152 - protein, 214 aa, Artificial Sequence
  Description of Artificial Sequence: Synthetic polypeptide
DIQMTQSPSSLSASVGDRVTITCTASQDISNYLNWYQQKPGKAPKLLIYYTSDLHIGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 153 - protein, 214 aa, Artificial Sequence
  Description of Artificial Sequence: Synthetic polypeptide
DIQMTQSPSSLSASVGDRVTITCSASNDISNYINWYQQKPGKAPKLLIYYTSNLHSGVPSRFSGSGSGTDFTLTISSLQPEDFATYYCQQFRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 154 - protein, 214 aa, Artificial Sequence
  Description of Artificial Sequence: Synthetic polypeptide
DIQMTQSPSSLSASVGDRVTITCSASQDISNFLNWYQQKPGKAPKLLIYYTSDLHSGVPSRFSGSGSGTDFTLTISSLQPEDFATYYCQQYYKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 155 - protein, 214 aa, Artificial Sequence
  Description of Artificial Sequence: Synthetic polypeptide
DIQMTQSPSSLSASVGDRVTITCSASQDISNYLNWYQQKPGKAPKLLIYYTSNLHSGVPSRFSGSGSGTDFTLTISSLQPEDFATYYCHQYKKTPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 156 - protein, 214 aa, Artificial Sequence
  Description of Artificial Sequence: Synthetic polypeptide
DIQMTQSPSSLSASVGDRVTITCRASQDISNYLNWYQQKPGKAPKLLIYYTSNLHSGVPSRFSGSGSGTDFTLTISSLQPEDFATYYCQQYRSIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 157 - protein, 214 aa, Artificial Sequence
  Description of Artificial Sequence: Synthetic polypeptide
DIQMTQSPSSLSASVGDRVTITCSASQDISNYLNWYQQKPGKAPKLLIYYTSNIHSGVPSRFSGSGSGTDFTLTISSLQPEDFATYYCQQYKKMPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 158 - protein, 214 aa, Artificial Sequence
  Description of Artificial Sequence: Synthetic polypeptide
DIQMTQSPSSLSASVGDRVTITCSASNSISNYLNWYQQKPGKAPKLLIYYASNLHSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 159 - protein, 214 aa, Artificial Sequence
  Description of Artificial Sequence: Synthetic polypeptide
DIQMTQSPSSLSASVGDRVTITCSASQDISNYLNWYQQKPGKAPKLLIYAASNLHSGVPSRFSGSGSGTDFTLTISSLQPEDFATYYCQQYRKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 160 - protein, 214 aa, Artificial Sequence
  Description of Artificial Sequence: Synthetic polypeptide
DIQMTQSPSSLSASVGDRVTITCSASQDISNYLNWYQQKPGKAPKLLIYYSSSLHIGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 161 - protein, 214 aa, Artificial Sequence
  Description of Artificial Sequence: Synthetic polypeptide
DIQMTQSPSSLSASVGDRVTITCSASQDITNYLNWYQQKPGKAPKLLIYFTSNLHSGVPSRFSGSGSGTDFTLTISSLQPEDFATYYCQQYYKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 162 - protein, 214 aa, Artificial Sequence
  Description of Artificial Sequence: Synthetic polypeptide
DIQMTQSPSSLSASVGDRVTITCSASQDISNFLNWYQQKPGKAPKLLIYYTSNMHSGVPSRFSGSGSGTDFTLTISSLQPEDFATYYCQQYRSLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 163 - protein, 214 aa, Artificial Sequence
  Description of Artificial Sequence: Synthetic polypeptide
DIQMTQSPSSLSASVGDRVTITCSASHDVSNYLNWYQQKPGKAPKLLIYYTSNLHSGVPSRFSGSGSGTDFTLTISSLQPEDFATYYCQQYRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 164 - protein, 214 aa, Artificial Sequence
  Description of Artificial Sequence: Synthetic polypeptide
DIQMTQSPSSLSASVGDRVTITCTASQSISNYINWYQQKPGKAPKLLIYYTSNLHSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 165 - protein, 214 aa, Artificial Sequence
  Description of Artificial Sequence: Synthetic polypeptide
DIQMTQSPSSLSASVGDRVTITCSASQDISNYLNWYQQKPGKAPKLLIYYTSNIHIGVPSRFSGSGSGTDFTLTISSLQPEDFATYYCQQYRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 166 - protein, 214 aa, Artificial Sequence
  Description of Artificial Sequence: Synthetic polypeptide
DIQMTQSPSSLSASVGDRVTITCSASQDLSNYLNWYQQKPGKAPKLLIYYTSSLHSGVPSRFSGSGSGTDFTLTISSLQPEDFATYYCQQYRKTPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 167 - protein, 214 aa, Artificial Sequence
  Description of Artificial Sequence: Synthetic polypeptide
DIQMTQSPSSLSASVGDRVTITCSASQDISSYLNWYQQKPGKAPKLLIYFTSNLHSGVPSRFSGSGSGTDFTLTISSLQPEDFATYYCQQSRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 168 - protein, 214 aa, Artificial Sequence
  Description of Artificial Sequence: Synthetic polypeptide
DIQMTQSPSSLSASVGDRVTITCSASHDISNYLNWYQQKPGKAPKLLIYYTSNLHSGVPSRFSGSGSGTDFTLTISSLQPEDFATYYCHEYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 169 - protein, 214 aa, Artificial Sequence
  Description of Artificial Sequence: Synthetic polypeptide
DIQMTQSPSSLSASVGDRVTITCSASQDLSNYLNWYQQKPGKAPKLLIYYTSNLHSGVPSRFSGSGSGTDFTLTISSLQPEDFATYYCQQYKKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 170 - protein, 214 aa, Artificial Sequence
  Description of Artificial Sequence: Synthetic polypeptide
DIQMTQSPSSLSASVGDRVTITCSASQDLSNYLNWYQQKPGKAPKLLIYYTSNLQSGVPSRFSGSGSGTDFTLTISSLQPEDFATYYCQQYRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - protein, 214 aa, Artificial Sequence
  Description of Artificial Sequence: Synthetic polypeptide
DIQMTQSPSSLSASVGDRVTITCRASQSISSYLNWYQQKPGKAPKLLIYYTSNLHSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 172 - protein, 214 aa, Artificial Sequence
  Description of Artificial Sequence: Synthetic polypeptide
DIQMTQSPSSLSASVGDRVTITCSASQDISNYLNWYQQKPGKAPKLLIYAASSLQSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 173 - protein, 214 aa, Artificial Sequence
  Description of Artificial Sequence: Synthetic polypeptide
DIQMTQSPSSLSASVGDRVTITCSASQDISNYLNWYQQKPGKAPKLLIYYTSNLHSGVPSRFSGSGSGTDFTLTISSLQPEDFATYYCQQSYSTPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 174 - protein, 214 aa, Artificial Sequence; identical to SEQ ID NO: 140
  Description of Artificial Sequence: Synthetic polypeptide

SEQ ID NO: 175 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSETYYNEKFKGRVTITADKSTSTAYMELSSLRSEDTAVYYCARGAIYHGYDVLDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 176 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDTYYNQKFQGRVTITADKSTSTAYMELSSLRSEDTAVYYCARGAVFHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 177 - protein, 224 aa, Artificial Sequence
  Description of Artificial Sequence: Synthetic polypeptide
QVQLVQSGAEVKKPGSSVKVSCKASGGTFSNYWMSWVRQAPGQGLEWMGATYRGHSQTYYNQKFKGRVTITADKSTSTAYMELSSLRSEDTAVYYCARGAVYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 178 - protein, 224 aa, Artificial Sequence
  Description of Artificial Sequence: Synthetic polypeptide
QVQLVQSGAEVKKPGSSVKVSCKATGGTFSNYWMHWVRQAPGQGLEWMGATYRGHSNTYYDQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 179 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDSNYNNKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 180 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGAIYRGHSDTYYNQKFKSRVTITADKSTSTAYMELSSLRSEDTAVYYCARGAIYHGYNVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 181 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHGDTYYNHKFKGRVTITADKSTSTAYMELSSLRSEDTAVYYCARGAIYHGYNVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 182 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRSHSDTYYNQKFKGRVTITADESTSTAYMELSSLRSEDTAVYYCARGAIFHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 183 - protein, 224 aa, Artificial Sequence
  Description of Artificial Sequence: Synthetic polypeptide
QVQLVQSGAEVKKPGSSVKVSCKASGGTFSSYWMQWVRQAPGQGLEWMGATYRGHSDTYFNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 184 - protein, 224 aa, Artificial Sequence
  Description of Artificial Sequence: Synthetic polypeptide
QVQLVQSGAEVKKPGSSVKVSCKASGGTFSNYWLHWVRQAPGQGLEWMGAIYRGHSDAYYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 185 - protein, 224 aa, Artificial Sequence
  Description of Artificial Sequence: Synthetic polypeptide
QVQLVQSGAEVKKPGSSVKVSCKASGGTFSNFWMHWVRQAPGQGLEWMGATYRGHSDTYYDQKFKGRVTITADKSTSTAYMELSSLRSEDTAVYYCARGAIYHGYDVLDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 186 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATIRSHSDTYYNNKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 187 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSTTYYAQKYKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 188 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGGTYRGHTDTYYNQKFKGRVTITADKSTSTAYMELSSLRSEDTAVYYCARGAIYHGYNVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 189 - protein, 224 aa, Artificial Sequence
  Description of Artificial Sequence: Synthetic polypeptide
QVQLVQSGAEVKKPGSSVKVSCKASGGTYSNYWMHWVRQAPGQGLEWMGATYRGHSDAYYNQRFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 190 - protein, 224 aa, Artificial Sequence
  Description of Artificial Sequence: Synthetic polypeptide
QVQLVQSGAEVKKPGSSVKVSCKASGGTFSTYWMHWVRQAPGQGLEWMGATYRIHSDTYYNQKFKGRVTITADESTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 191 - protein, 224 aa, Artificial Sequence
  Description of Artificial Sequence: Synthetic polypeptide
QVQLVQSGAEVKKPGSSVKVSCKASGGTFSSYWMHWVRQAPGQGLEWMGATYRGHSDTYYAQKFKGRVTITADKSTSTAYMELSSLRSEDTAVYYCARGAIYHGYEVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 192 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYKGHSDTYYNQKFKGRVTITADESTSTAYMELSSLRSEDTAVYYCARGAIYHGYEVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 193 - protein, 224 aa, Artificial Sequence
  Description of Artificial Sequence: Synthetic polypeptide
QVQLVQSGAEVKKPGSSVKVSCKASGGSFSNYWMQWVRQAPGQGLEWMGATYRGHSDTYYNQKFKGRVTITADKSTSTAYMELSSLRSEDTAVYYCARGSIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 194 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATIRGHSQTYYNQKFQGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 195 - protein, 224 aa, Artificial Sequence
  Description of Artificial Sequence: Synthetic polypeptide
QVQLVQSGAEVKKPGSSVKVSCKASGGTFSNYAMHWVRQAPGQGLEWMGATYRGQSDTYYNQKYKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 196 - protein, 224 aa, Artificial Sequence
  Description of Artificial Sequence: Synthetic polypeptide
QVQLVQSGAEVKKPGSSVKVSCKASGGTFSNYWMSWVRQAPGQGLEWMGATYRGHGDTYYNEKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 197 - protein, 224 aa, Artificial Sequence
  Description of Artificial Sequence: Synthetic polypeptide
QVQLVQSGAEVKKPGSSVKVSCKASGGTFSNYYMHWVRQAPGQGLEWMGATYRGHSDTFYAQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 198 - protein, 224 aa, Artificial Sequence
  Description of Artificial Sequence: Synthetic polypeptide
QVQLVQSGAEVKKPGSSVKVSCKASGGTFTNYWMHWVRQAPGQGLEWMGATYRGHSNTYYNQKFKGRVTITADKSTSTAYMELSSLRSEDTAVYYCARGAIYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 199 - protein, 224 aa, Artificial Sequence
  Description of Artificial Sequence: Synthetic polypeptide
QVQLVQSGAEVKKPGSSVKVSCKASGGTFSNYAMHWVRQAPGQGLEWMGATYRGHSDTYYNQKFKGRVTITADKSTSTAYMELSSLRSEDTAVYYCARGSLYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 200 - protein, 224 aa, Artificial Sequence
  Description of Artificial Sequence: Synthetic polypeptide
QVQLVQSGAEVKKPGSSVKVSCKASGGSFSNYWMHWVRQAPGQGLEWMGATYRIHSDTFYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 201 - protein, 224 aa, Artificial Sequence
  Description of Artificial Sequence: Synthetic polypeptide
QVQLVQSGAEVKKPGSSVKVSCKATGGTFSNYWMHWVRQAPGQGLEWMGAIYRGHSDTYYNQKFRGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 202 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGASYRGHSDTYYNQKFQGRVTITADKSTSTAYMELSSLRSEDTAVYYCARGAIYHGYDVLNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 203 - protein, 224 aa, Artificial Sequence
  Description of Artificial Sequence: Synthetic polypeptide
QVQLVQSGAEVKKPGSSVKVSCKASGGTFSTYWMHWVRQAPGQGLEWMGATYRGHSDSYYNQKFKGRVTITADKSTSTAYMELSSLRSEDTAVYYCARGALYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 204 - protein, 224 aa, Artificial Sequence
  Description of Artificial Sequence: Synthetic polypeptide
QVQLVQSGAEVKKPGSSVKVSCKASGGTYSNYWMHWVRQAPGQGLEWMGATYRGHTDTYYNQKFKGRVTITADKSTSTAYMELSSLRSEDTAVYYCARGAIYHGYDVMDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 205 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGGTYRGHSDTYFNQKFKGRVTITADKSTSTAYMELSSLRSEDTAVYYCARGAIYHGFDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 206 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRSHSDTYYNQKFKSRVTITADKSTSTAYMELSSLRSEDTAVYYCARGAIYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 207 - protein, 224 aa, Artificial Sequence
  Description of Artificial Sequence: Synthetic polypeptide
QVQLVQSGAEVKKPGSSVKVSCKASGGTFTNFWMHWVRQAPGQGLEWMGATYRGQSDTYYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 208 - protein, 224 aa, Artificial Sequence
  Description of Artificial Sequence: Synthetic polypeptide
QVQLVQSGAEVKKPGSSVKVSCKASGGTFSNYYLHWVRQAPGQGLEWMGATYRGHSDTYYNQKFKGRVTITADKSTSTAYMELSSLRSEDTAVYYCARGAIYNGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 209 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATFKGHSDTYYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 210 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATFRGHSDTYYNHKFKGRVTITADKSTSTAYMELSSLRSEDTAVYYCARGAIYHGFDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 211 - protein, 224 aa, Artificial Sequence
  Description of Artificial Sequence: Synthetic polypeptide
QVQLVQSGAEVKKPGSSVKVSCKASGGTFTNYWMHWVRQAPGQGLEWMGATYKGHSDTYYNQKFRGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 212 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDTYFNQKFKGRVTITADKSTSTAYMELSSLRSEDTAVYYCARGAIFNGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 213 - protein, 224 aa, Artificial Sequence
  Description of Artificial Sequence: Synthetic polypeptide
QVQLVQSGAEVKKPGSSVKVSCKASGGTFSDYWMHWVRQAPGQGLEWMGATIRGHSDTYYNQKFKGRVTITADKSTSTAYMELSSLRSEDTAVYYCARGAIYHGYDVLENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 214 - protein, 224 aa, Artificial Sequence
  Description of Artificial Sequence: Synthetic polypeptide
QVQLVQSGAEVKKPGSSVKVSCKASGGTFSNFWMHWVRQAPGQGLEWMGATYRGHSDTYYNHKFKGRVTITADKSTSTAYMELSSLRSEDTAVYYCARGAIYHGYDVLENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 215 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDTYYNEKFKGRVTITADKSTSTAYMELSSLRSEDTAVYYCARGAIYHGYDILNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 216 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSTTYYNQKFKGRVTITADKSTSTAYMELSSLRSEDTAVYYCARGSIYHGYDVMDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 217 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSQTYYNQKFKGRVTITADKSTSTAYMELSSLRSEDTAVYYCARGTIYHGYDILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 218 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGGTYRGHSDTYYNQRFKGRVTITADKSTSTAYMELSSLRSEDTAVYYCARGAIYHGYDILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 219 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDTYYNNKFKGRVTITADKSTSTAYMELSSLRSEDTAVYYCARGAIYHGYDVLEDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 220 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDTNYNQKYKGRVTITADKSTSTAYMELSSLRSEDTAVYYCARGAIYNGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 221 - protein, 224 aa, Artificial Sequence
  Description of Artificial Sequence: Synthetic polypeptide
QVQLVQSGAEVKKPGSSVKVSCKASGGTFSNYWLHWVRQAPGQGLEWMGATYRGHSDTYYDQKFKGRVTITADKSTSTAYMELSSLRSEDTAVYYCARGALYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 222 - protein, 224 aa, Artificial Sequence
  Description of Artificial Sequence: Synthetic polypeptide
QVQLVQSGAEVKKPGSSVKVSCKASGGTFSDYWMHWVRQAPGQGLEWMGATYRGHSDTYYNQRFKGRVTITADKSTSTAYMELSSLRSEDTAVYYCARGAIYHGYDVMDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 223 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGASYRGHSDTYYNQKFKGRVTITADKSTSTAYMELSSLRSEDTAVYYCARGAIYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 224 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATFRGHSDTYYNQKFKSRVTITADKSTSTAYMELSSLRSEDTAVYYCARGAVYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 225 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHSDTNYNQKFKGRVTITADKSTSTAYMELSSLRSEDTAVYYCARGTIYHGFDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 226 - protein, 224 aa, Artificial Sequence
  Description of Artificial Sequence: Synthetic polypeptide
QVQLVQSGAEVKKPGSSVKVSCKASGGSFSDYWMHWVRQAPGQGLEWMGATYRGHSTTYYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 227 - protein, 224 aa, Artificial Sequence
  Description of Artificial Sequence: Synthetic polypeptide
QVQLVQSGAEVKKPGSSVKVSCKASGGTFSNYWMQWVRQAPGQGLEWMGATYRGHTETYYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 228 - protein, 224 aa, Artificial Sequence
  Description of Artificial Sequence: Synthetic polypeptide
QVQLVQSGAEVKKPGSSVKVSCKASGGTFSNYWMHWVRQAPGQGLEWMGATYRGHGDTFYNQKFKGRVTITADKSTSTAYMELSSLRSEDTAVYYCARGAIYHGYDVLNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 229 - protein, 224 aa, Artificial Sequence
  Description of Artificial Sequence: Synthetic polypeptide
QVQLVQSGAEVKKPGSSVKVSCKASGGTFSTYWMHWVRQAPGQGLEWMGATYRGQSDTYYNQKFKGRVTITADKSTSTAYMELSSLRSEDTAVYYCARGAIYHGYEVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 230 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRGHSDTYYNQKFRGRVTITADKSTSTAYMELSSLRSEDTAVYYCARGTIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 231 - protein, 224 aa, Artificial Sequence
  Description of Artificial Sequence: Synthetic polypeptide
QVQLVQSGAEVKKPGSSVKVSCKASGGTYSNYYMHWVRQAPGQGLEWMGATYRGHSETYYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 232 - protein, 224 aa, Artificial Sequence
  Description of Artificial Sequence: Synthetic polypeptide
QVQLVQSGAEVKKPGSSVKVSCKASGGTFSNYWMSWVRQAPGQGLEWMGATYRGHSNAYYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 233 - protein, 224 aa, Artificial Sequence
  Description of Artificial Sequence: Synthetic polypeptide
QVQLVQSGAEVKKPGSSVKVSCKATGGTFSNYAMHWVRQAPGQGLEWMGASYRGHSDTYYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 234 - protein, 224 aa, Artificial Sequence
  Description of Artificial Sequence: Synthetic polypeptide
QVQLVQSGAEVKKPGSSVKVSCKASGGTFSSYWMHWVRQAPGQGLEWMGATYRIHSDSYYNQKFKGRVTITADKSTSTAYMELSSLRSEDTAVYYCARGAIYHGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 235 - protein, 224 aa, Artificial Sequence; identical to SEQ ID NO: 200
  Description of Artificial Sequence: Synthetic polypeptide

SEQ ID NO: 236 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQFRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 237 - protein, 214 aa, Artificial Sequence
  Description of Artificial Sequence: Synthetic polypeptide
DIQMTQSPSSLSASVGDRVTITCRASQSISSYINWYQQKPGKAPKLLIYAASSLQSGVPSRFSGSGSGTDFTLTISSLQPEDFATYYCQQFRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 238 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQSGVPSRFSGSGSGTDFTLTISSLQPEDFATYYCQQFRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 239 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNIQSGVPSRFSGSGSGTDFTLTISSLQPEDFATYYCQQFRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 240 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQIGVPSRFSGSGSGTDFTLTISSLQPEDFATYYCQQFRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 241 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQSGVPSRFSGSGSGTDFTLTISSLQPEDFATYYCQQFRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 242 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNIQSGVPSRFSGSGSGTDFTLTISSLQPEDFATYYCQQFRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 243 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQIGVPSRFSGSGSGTDFTLTISSLQPEDFATYYCQQFRKLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 244 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQYRRLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 245 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 246 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQFRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 247 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQYRKIPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 248 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQFRKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 249 - protein, 214 aa, Artificial Sequence
  Description of Artificial Sequence: Synthetic polypeptide
DIQMTQSPSSLSASVGDRVTITCRASQSISSYINWYQQKPGKAPKLLIYAASSLQSGVPSRFSGSGSGTDFTLTISSLQPEDFATYYCQQYRRLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 250 - protein, 214 aa, Artificial Sequence
  Description of Artificial Sequence: Synthetic polypeptide
DIQMTQSPSSLSASVGDRVTITCRASQSISSYINWYQQKPGKAPKLLIYAASSLQSGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 251 - protein, 214 aa, Artificial Sequence
  Description of Artificial Sequence: Synthetic polypeptide
DIQMTQSPSSLSASVGDRVTITCRASQSISSYINWYQQKPGKAPKLLIYAASSLQSGVPSRFSGSGSGTDFTLTISSLQPEDFATYYCQQFRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 252 - protein, 214 aa, Artificial Sequence
  Description of Artificial Sequence: Synthetic polypeptide
DIQMTQSPSSLSASVGDRVTITCRASQSISSYINWYQQKPGKAPKLLIYAASSLQSGVPSRFSGSGSGTDFTLTISSLQPEDFATYYCQQYRKIPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 253 - protein, 214 aa, Artificial Sequence
  Description of Artificial Sequence: Synthetic polypeptide
DIQMTQSPSSLSASVGDRVTITCRASQSISSYINWYQQKPGKAPKLLIYAASSLQSGVPSRFSGSGSGTDFTLTISSLQPEDFATYYCQQFRKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 254 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQSGVPSRFSGSGSGTDFTLTISSLQPEDFATYYCQQYRRLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 255 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQSGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 256 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQSGVPSRFSGSGSGTDFTLTISSLQPEDFATYYCQQFRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 257 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQSGVPSRFSGSGSGTDFTLTISSLQPEDFATYYCQQYRKIPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 258 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQSGVPSRFSGSGSGTDFTLTISSLQPEDFATYYCQQFRKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 259 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNIQSGVPSRFSGSGSGTDFTLTISSLQPEDFATYYCQQYRRLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 260 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNIQSGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 261 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNIQSGVPSRFSGSGSGTDFTLTISSLQPEDFATYYCQQFRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 262 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNIQSGVPSRFSGSGSGTDFTLTISSLQPEDFATYYCQQYRKIPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 263 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNIQSGVPSRFSGSGSGTDFTLTISSLQPEDFATYYCQQFRKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 264 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQIGVPSRFSGSGSGTDFTLTISSLQPEDFATYYCQQYRRLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 265 - protein, 214 aa, Artificial Sequence; identical to SEQ ID NO: 97
  Description of Artificial Sequence: Synthetic polypeptide

SEQ ID NO: 266 - protein, 214 aa, Artificial Sequence; identical to SEQ ID NO: 93
  Description of Artificial Sequence: Synthetic polypeptide

SEQ ID NO: 267 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQIGVPSRFSGSGSGTDFTLTISSLQPEDFATYYCQQYRKIPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 268 - protein, 214 aa, Artificial Sequence
  Description of Artificial Sequence: Synthetic polypeptide
DIQMTQSPSSLSASVGDRVTITCRASQSISSYLNWYQQKPGKAPKLLIYATSNLQIGVPSRFSGSGSGTDFTLTISSLQPEDFATYYCQQFRKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 269 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQSGVPSRFSGSGSGTDFTLTISSLQPEDFATYYCQQYRRLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 270 - protein, 214 aa, Artificial Sequence; identical to SEQ ID NO: 103
  Description of Artificial Sequence: Synthetic polypeptide

SEQ ID NO: 271 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQSGVPSRFSGSGSGTDFTLTISSLQPEDFATYYCQQFRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 272 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQSGVPSRFSGSGSGTDFTLTISSLQPEDFATYYCQQYRKIPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 273 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQSGVPSRFSGSGSGTDFTLTISSLQPEDFATYYCQQFRKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 274 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNIQSGVPSRFSGSGSGTDFTLTISSLQPEDFATYYCQQYRRLPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 275 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNIQSGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 276 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNIQSGVPSRFSGSGSGTDFTLTISSLQPEDFATYYCQQFRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 277 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNIQSGVPSRFSGSGSGTDFTLTISSLQPEDFATYYCQQYRKIPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 278 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNIQSGVPSRFSGSGSGTDFTLTISSLQPEDFATYYCQQFRKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 279 - protein, 214 aa, Artificial Sequence; identical to SEQ ID NO: 101
  Description of Artificial Sequence: Synthetic polypeptide

SEQ ID NO: 280 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQIGVPSRFSGSGSGTDFTLTISSLQPEDFATYYCQQYRRIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 281 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQIGVPSRFSGSGSGTDFTLTISSLQPEDFATYYCQQFRRLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 282 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQIGVPSRFSGSGSGTDFTLTISSLQPEDFATYYCQQYRKIPWSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 283 - protein, 214 aa, Artificial Sequence
  Description of Artificial Sequence: Synthetic polypeptide
DIQMTQSPSSLSASVGDRVTITCRASQSISSYINWYQQKPGKAPKLLIYATSNLQIGVPSRFSGSGSGTDFTLTISSLQPEDFATYYCQQFRKIPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 284 - protein, 224 aa, Artificial Sequence; identical to SEQ ID NO: 206
  Description of Artificial Sequence: Synthetic polypeptide

SEQ ID NO: 285 - protein, 214 aa, Artificial Sequence; identical to SEQ ID NO: 236
  Description of Artificial Sequence: Synthetic polypeptide

SEQ ID NO: 286 - protein, 214 aa, Artificial Sequence; identical to SEQ ID NO: 237
  Description of Artificial Sequence: Synthetic polypeptide

SEQ ID NO: 287 - protein, 214 aa, Artificial Sequence; identical to SEQ ID NO: 238
  Description of Artificial Sequence: Synthetic polypeptide

SEQ ID NO: 288 - protein, 214 aa, Artificial Sequence; identical to SEQ ID NO: 239
  Description of Artificial Sequence: Synthetic polypeptide

SEQ ID NO: 289 - protein, 214 aa, Artificial Sequence; identical to SEQ ID NO: 240
  Description of Artificial Sequence: Synthetic polypeptide

SEQ ID NO: 290 - protein, 214 aa, Artificial Sequence; identical to SEQ ID NO: 241
  Description of Artificial Sequence: Synthetic polypeptide

SEQ ID NO: 291 - protein, 214 aa, Artificial Sequence; identical to SEQ ID NO: 242
  Description of Artificial Sequence: Synthetic polypeptide

SEQ ID NO: 292 - protein, 214 aa, Artificial Sequence; identical to SEQ ID NO: 243
  Description of Artificial Sequence: Synthetic polypeptide

SEQ ID NO: 293 - protein, 214 aa, Artificial Sequence; identical to SEQ ID NO: 244
  Description of Artificial Sequence: Synthetic polypeptide

SEQ ID NO: 294 - protein, 214 aa, Artificial Sequence; identical to SEQ ID NO: 245
  Description of Artificial Sequence: Synthetic polypeptide

SEQ ID NO: 295 - protein, 214 aa, Artificial Sequence; identical to SEQ ID NO: 246
  Description of Artificial Sequence: Synthetic polypeptide

SEQ ID NO: 296 - protein, 214 aa, Artificial Sequence; identical to SEQ ID NO: 247
  Description of Artificial Sequence: Synthetic polypeptide

SEQ ID NO: 297 - protein, 214 aa, Artificial Sequence; identical to SEQ ID NO: 248
  Description of Artificial Sequence: Synthetic polypeptide

SEQ ID NO: 298 - protein, 214 aa, Artificial Sequence; identical to SEQ ID NO: 249
  Description of Artificial Sequence: Synthetic polypeptide

SEQ ID NO: 299 - protein, 214 aa, Artificial Sequence; identical to SEQ ID NO: 250
  Description of Artificial Sequence: Synthetic polypeptide

SEQ ID NO: 300 - protein, 214 aa, Artificial Sequence; identical to SEQ ID NO: 251
  Description of Artificial Sequence: Synthetic polypeptide

SEQ ID NO: 301 - protein, 214 aa, Artificial Sequence; identical to SEQ ID NO: 252
  Description of Artificial Sequence: Synthetic polypeptide

SEQ ID NO: 302 - protein, 214 aa, Artificial Sequence; identical to SEQ ID NO: 253
  Description of Artificial Sequence: Synthetic polypeptide

SEQ ID NO: 303 - protein, 214 aa, Artificial Sequence; identical to SEQ ID NO: 254
  Description of Artificial Sequence: Synthetic polypeptide

SEQ ID NO: 304 - protein, 214 aa, Artificial Sequence; identical to SEQ ID NO: 255
  Description of Artificial Sequence: Synthetic polypeptide

SEQ ID NO: 305 - protein, 214 aa, Artificial Sequence; identical to SEQ ID NO: 256
  Description of Artificial Sequence: Synthetic polypeptide

SEQ ID NO: 306 - protein, 214 aa, Artificial Sequence; identical to SEQ ID NO: 257
  Description of Artificial Sequence: Synthetic polypeptide

SEQ ID NO: 307 - protein, 214 aa, Artificial Sequence; identical to SEQ ID NO: 258
  Description of Artificial Sequence: Synthetic polypeptide

SEQ ID NO: 308 - protein, 214 aa, Artificial Sequence; identical to SEQ ID NO: 259
  Description of Artificial Sequence: Synthetic polypeptide

SEQ ID NO: 309 - protein, 214 aa, Artificial Sequence; identical to SEQ ID NO: 260
  Description of Artificial Sequence: Synthetic polypeptide

SEQ ID NO: 310 - protein, 214 aa, Artificial Sequence; identical to SEQ ID NO: 261
  Description of Artificial Sequence: Synthetic polypeptide

SEQ ID NO: 311 - protein, 214 aa, Artificial Sequence; identical to SEQ ID NO: 262
  Description of Artificial Sequence: Synthetic polypeptide

SEQ ID NO: 312 - protein, 214 aa, Artificial Sequence; identical to SEQ ID NO: 263
  Description of Artificial Sequence: Synthetic polypeptide

SEQ ID NO: 313 - protein, 214 aa, Artificial Sequence; identical to SEQ ID NO: 264
  Description of Artificial Sequence: Synthetic polypeptide

SEQ ID NO: 314 - protein, 214 aa, Artificial Sequence; identical to SEQ ID NO: 97
  Description of Artificial Sequence: Synthetic polypeptide

SEQ ID NO: 315 - protein, 214 aa, Artificial Sequence; identical to SEQ ID NO: 93
  Description of Artificial Sequence: Synthetic polypeptide

SEQ ID NO: 316 - protein, 214 aa, Artificial Sequence; identical to SEQ ID NO: 267
  Description of Artificial Sequence: Synthetic polypeptide

SEQ ID NO: 317 - protein, 214 aa, Artificial Sequence; identical to SEQ ID NO: 268
  Description of Artificial Sequence: Synthetic polypeptide

SEQ ID NO: 318 - protein, 214 aa, Artificial Sequence; identical to SEQ ID NO: 269
  Description of Artificial Sequence: Synthetic polypeptide

SEQ ID NO: 319 - protein, 214 aa, Artificial Sequence; identical to SEQ ID NO: 103
  Description of Artificial Sequence: Synthetic polypeptide

SEQ ID NO: 320 - protein, 214 aa, Artificial Sequence; identical to SEQ ID NO: 271
  Description of Artificial Sequence: Synthetic polypeptide

SEQ ID NO: 321 - protein, 214 aa, Artificial Sequence; identical to SEQ ID NO: 272
  Description of Artificial Sequence: Synthetic polypeptide

SEQ ID NO: 322 - protein, 214 aa, Artificial Sequence; identical to SEQ ID NO: 273
  Description of Artificial Sequence: Synthetic polypeptide

SEQ ID NO: 323 - protein, 214 aa, Artificial Sequence; identical to SEQ ID NO: 274
  Description of Artificial Sequence: Synthetic polypeptide

SEQ ID NO: 324 - protein, 214 aa, Artificial Sequence; identical to SEQ ID NO: 275
  Description of Artificial Sequence: Synthetic polypeptide

SEQ ID NO: 325 - protein, 214 aa, Artificial Sequence; identical to SEQ ID NO: 276
  Description of Artificial Sequence: Synthetic polypeptide

SEQ ID NO: 326 - protein, 214 aa, Artificial Sequence; identical to SEQ ID NO: 277
  Description of Artificial Sequence: Synthetic polypeptide

SEQ ID NO: 327 - protein, 214 aa, Artificial Sequence; identical to SEQ ID NO: 278
  Description of Artificial Sequence: Synthetic polypeptide

SEQ ID NO: 328 - protein, 214 aa, Artificial Sequence; identical to SEQ ID NO: 101
  Description of Artificial Sequence: Synthetic polypeptide

SEQ ID NO: 329 - protein, 214 aa, Artificial Sequence; identical to SEQ ID NO: 280
  Description of Artificial Sequence: Synthetic polypeptide

SEQ ID NO: 330 - protein, 214 aa, Artificial Sequence; identical to SEQ ID NO: 281
  Description of Artificial Sequence: Synthetic polypeptide

SEQ ID NO: 331 - protein, 214 aa, Artificial Sequence; identical to SEQ ID NO: 282
  Description of Artificial Sequence: Synthetic polypeptide

SEQ ID NO: 332 - protein, 214 aa, Artificial Sequence; identical to SEQ ID NO: 97
  Description of Artificial Sequence: Synthetic polypeptide

SEQ ID NO: 333 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGATYRSHSDTNYNQKYKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 334 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGGTYRSHSDTYYAQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 335 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGGTYRSHSDTNYNQKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 336 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRSHSTTYYNQKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 337 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRSHSDTYYNQKYKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 338 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSHSDTNYAQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 339 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSQSDTNYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 340 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSQSDTYYNQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 341 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGATYRIHSDTYYAEKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 342 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGATYRSHSDTNYAQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 343 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGATYRIHSTTYYAQKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 344 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGGTYRIHSDTYYAQKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 345 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGATYRIHSTTNYNQKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 346 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGGTYRIQSDTYYNQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 347 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRIHSDTYYAQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 348 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIQSTTYYNQKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 349 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIHSTTYYNEKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 350 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIHSDTNYNEKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 351 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIHSDTYYAEKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 352 - protein, 214 aa, Artificial Sequence; identical to SEQ ID NO: 93
  Description of Artificial Sequence: Synthetic polypeptide

SEQ ID NO: 353 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGATYRSHSTTYYNQKYKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 354 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGATYRSQSDTYYAQKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 355 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGATYRSHSDTYYAEKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 356 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGATYRSHSTTNYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 357 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRSHSDTNYNQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 358 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRSHSDTYYAQKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 359 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSHSTTNYNQKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 360 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSQSTTYYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 361 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSHSTTYYNEKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 362 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGGTYRSHSTTYYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 363 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSHSDTNYNEKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 364 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSQSDTYYAQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 365 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGGTYRIHSDTYYNQKYKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 366 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGATYRIHSTTYYNEKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 367 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGGTYRSHSDTYYNEKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 368 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGGTYRIHSDTNYNQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 369 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRIHSTTYYNQKFKSRVTITADESTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 370 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIHSTTYYNQKYKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 371 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIHSDTYYAQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 372 - protein, 224 aa, Artificial Sequence
  Description of Artificial Sequence: Synthetic polypeptide
QVQLVQSGAEVKKPGSSVKVSCKASGGTFSSYAISWVRQAPGQGLEWMGATYRSQSDTYYNQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 373 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGGIIPIFGTANYAQKFQGRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 374 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGGIIPIFGTANYAQKFQGRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 375 - protein, 224 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 376 - protein, 224 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 377 - protein, 224 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 378 - protein, 214 aa, Artificial Sequence; identical to SEQ ID NO: 243
  Description of Artificial Sequence: Synthetic polypeptide

SEQ ID NO: 379 - protein, 224 aa, Artificial Sequence
  Description of Artificial Sequence: Synthetic polypeptide
QVQLVQSGAEVKKPGSSVKVSCKASGGTFSSYAISWVRQAPGQGLEWMGATYRSQSDTYYNQKYKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 380 - protein, 224 aa, Artificial Sequence
  Description of Artificial Sequence: Synthetic polypeptide
QVQLVQSGAEVKKPGSSVKVSCKASGGTFSSYAISWVRQAPGQGLEWMGATYRSQSDTFYNQKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 381 - protein, 224 aa, Artificial Sequence
  Description of Artificial Sequence: Synthetic polypeptide
QVQLVQSGAEVKKPGSSVKVSCKASGGTFSSYAISWVRQAPGQGLEWMGATYRSQSDTFYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 382 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGGIIPIFGTANYAQKFQGRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 383 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGGIIPIFGTANYAQKFQGRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 384 - protein, 224 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 385 - protein, 214 aa, Artificial Sequence; identical to SEQ ID NO: 103
  Description of Artificial Sequence: Synthetic polypeptide

SEQ ID NO: 386 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGATYRSHSDTNYNEKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 387 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGATYRSQSTTYYNQKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 388 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSHSTTYYAQKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 389 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSHSDTNYNQKYKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 390 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSHSDTYYAEKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 391 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSQSDTYYNEKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 392 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGATYRIQSDTNYNQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 393 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGGTYRIHSTTYYNQKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 394 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGATYRIQSTTYYNQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 395 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGATYRIQSDTYYAQKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 396 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGATYRIHSTTYYNQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 397 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGATYRIHSDTYYAQKYKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 398 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGATYRSHSDTYYAQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 399 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRIHSDTYYNEKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 400 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIHSTTNYNQKFKSRVTITADESTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 401 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIQSDTNYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 402 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIQSDTYYNEKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 403 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGGTYRSQSDTYYNQKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 404 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGATYRSQSDTNYNQKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 405 - protein, 214 aa, Artificial Sequence; identical to SEQ ID NO: 101
  Description of Artificial Sequence: Synthetic polypeptide

SEQ ID NO: 406 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGGTYRSHSDTYYNQKYKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 407 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGATYRSHSTTYYNEKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 408 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRSQSDTYYNQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 409 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRSHSDTYYNEKFKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 410 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSHSTTYYNQKYKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 411 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRSHSDTYYAQKYKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 412 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGGTYRIHSDTYYNEKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 413 - protein, 224 aa, Artificial Sequence
  Description of Artificial Sequence: Synthetic polypeptide
QVQLVQSGAEVKKPGSSVKVSCKASGGTFTNYWIHWVRQAPGQGLEWMGATYRIHSDTNYAQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 414 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGATYRIHSDTNYNQKYKSRVTITADKSTSTAYMELSSLRSEDTAVYYCARGAIFHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 415 - protein, 224 aa, Artificial Sequence
  Description of Artificial Sequence: Synthetic polypeptide
QVQLVQSGAEVKKPGSSVKVSCKASGGSFSNYWIHWVRQAPGQGLEWMGATYRIHSDTNYNEKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 416 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRIHSDTNYNQKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 417 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRIQSDTYYNQKFKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 418 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGGTYRIHSDTYYNQKYKSRVTITADKSTSTAYMELSSLRSEDTAVYYCARGAIYHGYDVIENWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 419 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIHSTTYYAQKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 420 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIHSDTNYAQKFKSRVTITADESTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 421 - protein, 224 aa, Artificial Sequence
  Description of Artificial Sequence: Synthetic polypeptide
QVQLVQSGAEVKKPGSSVKVSCKASGGTYSNYWIHWVRQAPGQGLEWMGATYRSHSTTYYAQKFKSRVTITADKSTSTAYMELSSLRSEDTAVYYCARGAIYHGFDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 422 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIHSDTNYNQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 423 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIQSDTYYAQKFKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 424 - protein, 224 aa, Artificial Sequence
  Description of Artificial Sequence: Synthetic polypeptide
QVQLVQSGAEVKKPGSSVKVSCKASGGTFSNYWIHWVRQAPGQGLEWMGATYRIQSDTYYNQKYKSRVTITADKSTSTAYMELSSLRSEDTAVYYCARGAVYHGYDVIDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

The invention claimed is:

1. An isolated antibody or antigen-binding fragment, wherein the antibody or antigen-binding fragment is capable of binding to B-cell maturation antigen (BCMA) and comprises:
    (i) three HCDRs comprising amino acid sequences of SEQ ID NO: 1 (HCDR1), SEQ ID NO: 22 (HCDR2), and SEQ ID NO: 23 (HCDR3); and three LCDRs comprising amino acid sequences of SEQ ID NO: 24 (LCDR1), SEQ ID NO: 25 (LCDR2), and SEQ ID NO: 26 (LCDR3), as defined by the Kabat numbering system; or
    (ii) three HCDRs comprising amino acid sequences of SEQ ID NO: 55 (HCDR1), SEQ ID NO: 56 (HCDR2), and SEQ ID NO: 57 (HCDR3); and three LCDRs comprising amino acid sequences of SEQ ID NO: 40 (LCDR1), SEQ ID NO: 41 (LCDR2), and SEQ ID NO: 58 (LCDR3), as defined by the IMGT numbering system.

2. The antibody or antigen-binding fragment of claim 1, comprising: a heavy chain variable region that is at least 90% identical to an amino acid sequence of SEQ ID NO: 84, and a light chain variable region that is at least 90% identical to an amino acid sequence of SEQ ID NO: 85.

3. The antibody or antigen-binding fragment of claim 1, comprising: a heavy chain variable region comprising an amino acid sequence of SEQ ID NO: 84, and a light chain variable region comprising an amino acid sequence of SEQ ID NO: 85.

4. The antibody or antigen-binding fragment of claim 1, comprising a heavy chain constant region comprising an amino acid sequence of SEQ ID NO: 90 and a light chain constant region comprising an amino acid sequence of SEQ ID NO: 91.

5. The antibody or antigen-binding fragment of claim 4, wherein the heavy chain constant region further comprises a C-terminal lysine (K).

6. The antibody or antigen-binding fragment of claim 1, comprising a heavy chain comprising an amino acid sequence of SEQ ID NO: 100, and a light chain comprising an amino acid sequence of SEQ ID NO: 101.

7. The antibody or antigen-binding fragment of claim 6, further comprising a C-terminal lysine (K).

8. The antibody or antigen-binding fragment of claim 1, wherein the antibody or antigen-binding fragment is conjugated to a therapeutic agent.

9. An antibody-drug conjugate of Formula (I):

$$Ab\text{-}(L\text{-}D)_p \qquad (I)$$

wherein

Ab comprises the antibody or antigen-binding fragment of claim 1;

D is a splicing modulator comprising

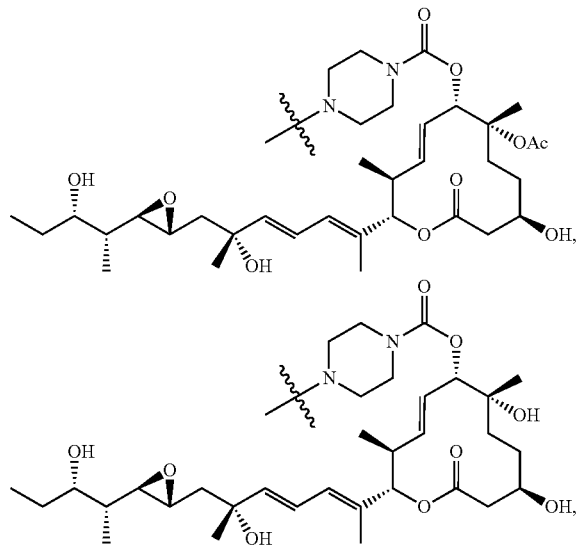

or a
pharmaceutically acceptable salt thereof;
L is a linker which covalently attaches Ab to D; and
p is an integer from 1 to 15.

10. The antibody-drug conjugate of claim 9, wherein the linker L is a cleavable linker comprising a cleavable moiety that comprises a cleavable peptide moiety or a cleavable glucuronide moiety.

11. The antibody-drug conjugate of claim 10, wherein the cleavable peptide moiety comprises valine-citrulline (Val-Cit) or valine-alanine (Val-Ala).

12. The antibody-drug conjugate of claim 10, wherein the linker attaches to the antibody or antigen binding fragment via a maleimide (Mal) moiety.

13. The antibody-drug conjugate of claim 12, wherein the Mal moiety comprises a maleimidocaproyl (MC).

14. The antibody-drug conjugate of claim 13, wherein the linker comprises MC-Val-Cit or MC-Val-Ala.

15. The antibody-drug conjugate of claim 14, wherein the MC is joined to the antibody or antigen binding fragment via a cysteine residue on the antibody or antigen binding fragment.

16. The antibody-drug conjugate of claim 10, wherein the linker comprises a spacer unit, wherein:

(a) the spacer unit comprises a polyethylene glycol (PEG) moiety, wherein the PEG moiety comprises -(PEG)$_m$- and m is an integer from 1 to 10, or
(b) the spacer unit comprises an alkyl moiety, wherein the alkyl moiety comprises —(CH$_2$)$_n$— and n is an integer from 1 to 10.

17. The antibody-drug conjugate of claim 16, wherein the spacer unit attaches to the antibody or antigen binding fragment via a maleimide (Mal) moiety ("Mal-spacer unit").

18. The antibody-drug conjugate of claim 17, wherein the Mal-spacer unit is joined to the antibody or antigen binding fragment via a cysteine residue on the antibody or antigen binding fragment.

19. The antibody-drug conjugate of claim 18, wherein the Mal-spacer unit comprises an alkyl moiety, and/or a PEG moiety.

20. The antibody-drug conjugate of claim 10, wherein linker L comprises a spacer unit that attaches the cleavable moiety to the splicing modulator.

21. The antibody-drug conjugate of claim 20, wherein cleavage of the cleavable moiety releases the splicing modulator from the antibody or antigen binding fragment.

22. The antibody-drug conjugate of claim 20, wherein the spacer unit attaching the cleavable moiety to the splicing modulator is self-immolative.

23. The antibody-drug conjugate of claim 20, wherein the spacer unit attaching the cleavable moiety in the linker to the splicing modulator comprises a p-aminobenzyloxycarbonyl (pABC).

24. The antibody-drug conjugate of claim 23, wherein the pABC attaches the cleavable moiety in the linker to the splicing modulator.

25. The antibody-drug conjugate of claim 23, wherein the linker comprises Val-Cit-pABC or Val-Ala-pABC.

26. The antibody-drug conjugate of claim 9, wherein the linker is a non-cleavable linker.

27. The antibody-drug conjugate of claim 9, wherein the linker L comprises:

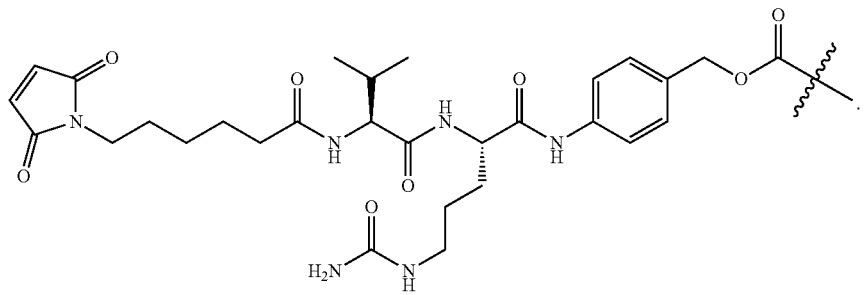 [SMILES: *C(=O)OCc1ccc(NC(=O)[C@H](CCCNC(N)=O)NC(=O)[C@@H](NC(=O)CCCCCN2C(=O)C=CC2=O)C(C)C)cc1]

28. The antibody-drug conjugate of claim 9, wherein the linker L comprises:

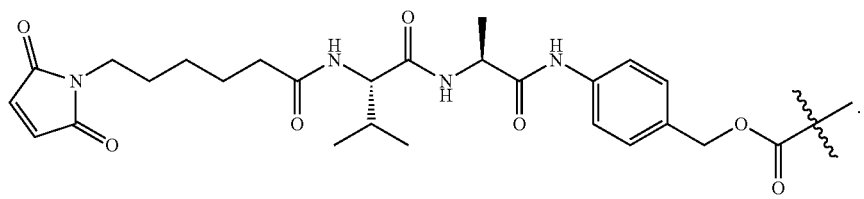 [SMILES: *C(=O)OCc1ccc(NC(=O)[C@H](C)NC(=O)[C@@H](NC(=O)CCCCCN2C(=O)C=CC2=O)C(C)C)cc1]

29. The antibody-drug conjugate of claim 9, wherein L-D comprises:

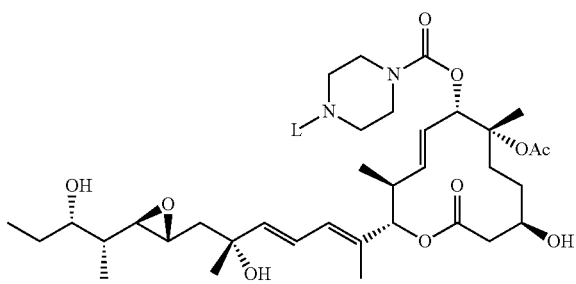

or a pharmaceutically acceptable salt thereof.

30. The antibody-drug conjugate of claim 9, wherein L-D comprises:

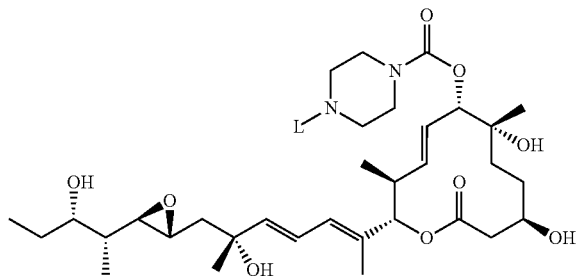

or a pharmaceutically acceptable salt thereof.

31. The antibody-drug conjugate of 9, wherein p is from 1 to 10.

32. The antibody-drug conjugate of 9, wherein Ab comprises a heavy chain variable region comprising an amino acid sequence of SEQ ID NO: 84, and a light chain variable region comprising an amino acid sequence of SEQ ID NO: 85.

33. A method of treating a subject having, or suspected of having, a neoplastic disorder, comprising administering a therapeutically effective amount of the antibody or antigen binding fragment of claim 1.

34. The method of claim 33, wherein the neoplastic disorder is: a hematological malignancy selected from acute myeloid leukemia and multiple myeloma or a solid tumor selected from breast cancer, gastric cancer, prostate cancer, ovarian cancer, lung cancer, uterine cancer, salivary duct carcinoma, melanoma, colon cancer, cervical cancer, pancreatic cancer, kidney cancer, colorectal cancer, and esophageal cancer.

35. The method of claim 33, wherein the neoplastic disorder is multiple myeloma.

36. A method of treating a subject having, or suspected of having, a neoplastic disorder, comprising administering a therapeutically effective amount of the antibody-drug conjugate of 9.

37. The method of claim 36, wherein the neoplastic disorder is: a hematological malignancy selected from acute myeloid leukemia and multiple myeloma or a solid tumor selected from breast cancer, gastric cancer, prostate cancer, ovarian cancer, lung cancer, uterine cancer, salivary duct carcinoma, melanoma, colon cancer, cervical cancer, pancreatic cancer, kidney cancer, colorectal cancer, and esophageal cancer.

38. The method of claim 36, wherein the neoplastic disorder is multiple myeloma.

39. The method of claim 36, wherein the antibody-drug conjugate is administered in combination with one or more additional therapeutic agents.

40. The method of claim 39, wherein the one or more additional therapeutic agents comprise a BCL2 inhibitor, a BCLxL inhibitor, a BCL2/BCLxL inhibitor, and/or a gamma secretase inhibitor.

41. A method of reducing or slowing the growth of a cancer cell population in a subject, comprising administering to the subject a therapeutically effective amount of the antibody-drug conjugate of claim 9.

42. An isolated nucleic acid encoding the antibody or antigen-binding fragment of claim 1.

43. An isolated vector comprising the nucleic acid of claim 42.

44. An isolated cell or cell population comprising the nucleic acid of claim 42.

45. A method of producing an antibody or antigen-binding fragment, comprising culturing the cell or cell population of claim 44 under conditions suitable to produce the antibody or antigen-binding fragment.

46. A method of producing an antibody-drug conjugate, comprising reacting the antibody or antigen-binding fragment of claim 1 with a linker attached to a splicing modulator under conditions that allow conjugation.

47. A pharmaceutical composition comprising the antibody or antigen binding fragment of claim 1 and a pharmaceutically acceptable excipient.

48. A pharmaceutical composition comprising the antibody-drug conjugate of claim 9 and a pharmaceutically acceptable excipient.

* * * * *